(12) United States Patent
Minomi et al.

(10) Patent No.: US 10,405,749 B2
(45) Date of Patent: *Sep. 10, 2019

(54) RNA AGENTS FOR P21 GENE MODULATION

(71) Applicant: Nitto Denko Corporation, Osaka (JP)

(72) Inventors: Kenjirou Minomi, Osaka (JP); Jens Harborth, San Diego, CA (US); Cima Cina, San Diego, CA (US); Kwok Yin Tsang, Irvine, CA (US); Wenbin Ying, San Diego, CA (US); Hirokazu Takahashi, Osaka (JP)

(73) Assignee: Nitto Denko Corporation, Osaka (JP)

( * ) Notice: Subject to any disclaimer, the term of this patent is extended or adjusted under 35 U.S.C. 154(b) by 0 days.

This patent is subject to a terminal disclaimer.

(21) Appl. No.: 14/979,568

(22) Filed: Dec. 28, 2015

(65) Prior Publication Data

US 2016/0208255 A1    Jul. 21, 2016

Related U.S. Application Data

(60) Provisional application No. 62/266,668, filed on Dec. 13, 2015, provisional application No. 62/184,209, filed on Jun. 24, 2015.

(30) Foreign Application Priority Data

Dec. 26, 2014    (JP) ................. 2014-266198

(51) Int. Cl.
| C12N 15/113 | (2010.01) |
| C07H 21/02 | (2006.01) |
| C07H 21/04 | (2006.01) |
| C07F 9/6533 | (2006.01) |
| C12Q 1/02 | (2006.01) |
| G01N 33/58 | (2006.01) |
| A61B 5/00 | (2006.01) |
| A61K 49/00 | (2006.01) |
| C07D 311/30 | (2006.01) |
| A61K 31/713 | (2006.01) |

(52) U.S. Cl.
CPC ........ *A61B 5/0071* (2013.01); *A61K 49/0021* (2013.01); *C07D 311/30* (2013.01); *C07F 9/6533* (2013.01); *C12N 15/113* (2013.01); *C12N 15/1135* (2013.01); *C12N 15/1137* (2013.01); *C12Q 1/02* (2013.01); *G01N 33/582* (2013.01); *H05K 999/99* (2013.01); *A61K 31/713* (2013.01); *C12N 2310/14* (2013.01); *C12N 2310/322* (2013.01); *C12N 2310/344* (2013.01); *C12N 2310/3515* (2013.01); *C12N 2310/531* (2013.01); *C12N 2320/30* (2013.01); *C12N 2320/32* (2013.01); *C12N 2320/35* (2013.01); *C12N 2320/53* (2013.01)

(58) Field of Classification Search
None
See application file for complete search history.

(56) References Cited

U.S. PATENT DOCUMENTS

| 8,067,390 B2 | 11/2011 | Merritt |
| 8,367,628 B2 | 2/2013 | Goodwin |
| 8,664,376 B2 | 3/2014 | Niitsu |
| 8,686,052 B2 | 4/2014 | Niitsu |
| 8,710,209 B2 | 4/2014 | Jin |
| 8,741,867 B2 | 6/2014 | Niitsu |
| 8,895,717 B2 | 11/2014 | Sood |
| 9,066,938 B2 * | 6/2015 | Saus ................. A61K 31/4406 |
| 9,206,424 B2 | 12/2015 | Jin |
| 2003/0144236 A1 | 7/2003 | Weiss |
| 2003/0165843 A1 | 9/2003 | Shoshan |
| 2005/0142596 A1 | 6/2005 | Krolewski |
| 2005/0233998 A1 | 10/2005 | Jadhav et al. |
| 2005/0245475 A1 | 11/2005 | Khvorova et al. |
| 2007/0031844 A1 * | 2/2007 | Khvorova ............ A61K 31/713 435/6.11 |
| 2007/0083334 A1 | 4/2007 | Mintz |
| 2009/0181379 A1 | 7/2009 | Corrales Izquierdo |

(Continued)

FOREIGN PATENT DOCUMENTS

| CN | 103695421 A | 4/2014 |
| WO | 2009029688 A2 | 3/2009 |

(Continued)

OTHER PUBLICATIONS

Vaishnaw, Review A status report on RNAi therapeutics, Silence, Dec. 31, 2010, vol. 1, pp. 14-26.

(Continued)

*Primary Examiner* — Jennifer Pitrak McDonald
(74) *Attorney, Agent, or Firm* — Knobbe, Martens, Olson & Bear, LLP

(57) ABSTRACT

This invention provides compounds, compositions and methods for modulating the expression of human p21 using RNA interference. The RNA interference molecules can be used in methods for preventing or treating diseases such as malignant tumor. A nucleic acid molecule can have a) a polynucleotide sense strand and a polynucleotide antisense strand; b) each strand of the molecule being from 15 to 30 nucleotides in length; c) a contiguous region of from 15 to 30 nucleotides of the antisense strand being complementary to a sequence of an mRNA encoding p21; and d) at least a portion of the sense strand can be complementary to at least a portion of the antisense strand, and the molecule has a duplex region of from 15 to 30 nucleotides in length.

9 Claims, 2 Drawing Sheets
Specification includes a Sequence Listing.

(56) References Cited

U.S. PATENT DOCUMENTS

| | | |
|---|---|---|
| 2009/0220956 A1 | 9/2009 | Nuyten |
| 2010/0196482 A1 | 8/2010 | Radovic-Moreno |
| 2011/0269819 A1 | 11/2011 | Jones |
| 2012/0142754 A1 | 6/2012 | Niitsu |
| 2013/0004494 A1 | 1/2013 | Heber-Katz |
| 2013/0196434 A1 | 8/2013 | Maier et al. |
| 2013/0330401 A1 | 12/2013 | Payne et al. |
| 2013/0345286 A1 | 12/2013 | Gollob |
| 2014/0005134 A1* | 1/2014 | Saus ............... A61K 31/4406 514/34 |
| 2014/0017780 A1 | 1/2014 | Bentwich et al. |
| 2014/0315976 A1 | 10/2014 | Brahmbhatt et al. |
| 2014/0356413 A1 | 12/2014 | Niitsu et al. |

FOREIGN PATENT DOCUMENTS

| | | |
|---|---|---|
| WO | 2009033284 A1 | 3/2009 |
| WO | 2012170952 A2 | 12/2012 |
| WO | 2013192364 A1 | 12/2013 |
| WO | 2014022739 A2 | 2/2014 |
| WO | 2014136086 A1 | 9/2014 |

OTHER PUBLICATIONS

Hokaiwado, Glutathione S-transferase Pi mediates proliferation of androgen-independent prostate cancer cells, Carcinogenesis, Jun. 1, 2008, vol. 29, pp. 1134-1138.
Sawers, Glutathione S-transferase P1 (GSTP1) directly influences platinum drug chemosensitivity in ovarian tumour cell lines, British Journal of Cancer, Sep. 9, 2014, vol. 111, pp. 1150-1158.
Love, Lipid-like materials for low-dose, in vivo gene silencing, Proc Natl Acad Sci U S A., 2010, vol. 107(5), pp. 1864-1869.
Xue, Small RNA combination therapy for lung cancer, Proc Natl Acad Sci U S A, 2014, vol. 111(34), pp. E3553-61.
Xu, Enhancing tumor cell response to chemotherapy through nanoparticle-mediated codelivery of siRNA and cisplatin prodrug, Proc Natl Acad Sci U S A, 2013, vol. 110, No. 46, pp. 18638-18643.
Ui-Tei, Functional dissection of siRNA sequence by systematic DNA substitution: modified siRNA with a DNA seed arm is a powerful tool for mammalian gene silencing with significantly reduced off-target effect, Nucleic Acids Res., 2008, vol. 36(7), pp. 2136-2151.
Niitsu, Serum Glutathione-S- Transferase-rr as a Tumor Marker for Gastrointestinal Malignancies, Cancer, Jan. 15, 1989, vol. 63, pp. 317-323.
Hirata, Significance of Glutathione S-Transferase-Pi as a Tumor Marker in Patients with Oral Cancer, Cancer, Nov. 15, 1992, vol. 70, No. 10, pp. 2381-2387.
Hida, Serum Glutathione S-Transferase-Pi Level as a Tumor Marker for Non-Small Cell Lung Cancer, Cancer, Mar. 1, 1994, vol. 73, No. 5, pp. 1377-1382.
Ban, Transfection of Glutathione S-Transferase (GST)-Pi Antisense Complementary DNA Increases the Sensitivity of a Colon Cancer Cell Line to Adriamycin, Cisplatin, Melphalan, and Etoposide, Cancer Research, Aug. 1, 1996, vol. 56, 3577-3582.
Morgan, Tumor Efficacy and Bone Marrow-sparing Properties of TER286, a Cytotoxin Activated by Glutathione S-Transferase, Cancer Research, Jun. 15. 1998, vol. 58, pp. 2568-2575.
Niitsu, A proof of glutathione S-transferase-pi-related multidrug resistance by transfer of antisense gene to cancer cells and sense gene to bone marrow stem cell, Chemico-Biological Interactions, 1998, vol. 111-112, pp. 325-332.
Miyanishi, Glutathione S-Transferase-pi Overexpression Is Closely Associated With K-ras Mutation During Human Colon Carcinogenesis, Gastroenterology, 2001, vol. 121, pp. 865-874.
Matsunaga, C(H)OP refractory chronic lymphocytic leukemia patients in whom salvage chemotherapy chosen by evaluating multiple chemotherapeutic drug-resistant factors was remarkably effective, Int J Clin Oncol, 2003, vol. 8, pp. 326-331.
Hayashi, Suppressive effect of sulindac on branch duct-intraductal papillary mucinous neoplasms, J Gastroenterol, 2009, vol. 44, pp. 964-975.
Morse, The role of glutathione S-transferase P1-1 in colorectal cancer: friend or foe?, Gastroenterology, 2001, vol. 121(4), pp. 1010-1013.
Steckel, Determination of synthetic lethal interactions in KRAS oncogene-dependent cancer cells reveals novel therapeutic targeting strategies, Cell Res., 2012, vol. 22(8), pp. 1227-1245.
Collins, KRAS as a key oncogene and therapeutic target in pancreatic cancer, Front Physiol., 2013, vol. 4, Article 407, pp. 1-8.
Tsao et al., Adenovirus-mediated p21 (WAF1 /SDI I/CIP1) gene transfer induces apoptosis of human cervical cancer cell lines, 1999, Journal of Virology, vol. 73, pp. 4983-4990.
Wu et al., Transcriptional regulation during p21 WAF1/CIP-induced apoptosis in human ovarian cancer cells, 2002, JBC, vol. 277, pp. 36329-36337.
Fan et al., An antisense oligodeoxynucleotide to p21 Waf1 /Cip1 causes apoptosis in human breast cancer cells, 2003, Molecular Cancer Therapeutics, vol. 2, pp. 773-782.
Zhang et al., Up-regulation of p21WAF1/CIP1 by small activating RNA inhibits the in vitro and in vivo growth of pancreatic cancer cells, 2012, Tumori, vol. 98, pp. 804-811.
Ashley, Delivery of Small Interfering RNA by Peptide-Targeted Mesoporous Silica Nanoparticle-Supported Lipid Bilayers, ACS Nano. Author Manuscript. Mar. 27, 2012, vol. 6, pp. 1-28.
Yoshimoto, Obesity-Induced Gut Microbial Metabolite Promotes Liver Cancer Through Senescence Secretome, Nature, 2013, pp. 1-7.
Krizhanovsky, Senescence of Activated Stellate Cells Limits Liver Fibrosis, Cell, Aug. 22, 2008, vol. 134, pp. 657-667.
Gupta, Synergistic Tumor Suppression by Combined Inhibition of Telomerase and CDKN1A6, PNAS, Jul. 14, 2014, E3062-E3071.
Sato, Resolution of Liver Cirrhosis Using Vitamin A-Coupled Liposomes to Deliver siRNA Against a Collagen-Specific Chaperone, Nature Biotechnology, Apr. 2008, vol. 26, pp. 431-442.
Cho, Pirfenidone: An Anti-Fibrotic and Cytoprotective Agent As Therapy for Progressive Kidney Disease, Expert Opin Investig Drugs, Author Manuscript, Mar. 16, 2011, vol. 19, pp. 1-13.
Extended European Search Report dated May 2, 2018 for the European Patent Application No. 15874362.5.
Elbashir et al., Functional anatomy of siRNAs for mediating efficient RNAi in Drosophila melanogaster embryo lysate, EMBO J. 2001, 20(23):6877-6888.

* cited by examiner

SEQ ID NO:1

```
GTTGTATATCAGGGCCGCGCTGAGCTGCGCCAGCTGAGGTGTGAGCAGCTGCCGAAGTCAGTTCCTTGTG
GAGCCGGAGCTGGGCGCGGATTCGCCGAGGCACCGAGGCACTCAGAGGAGGCGCCATGTCAGAACCGGCT
GGGGATGTCCGTCAGAACCCATGCGGCAGCAAGGCCTGCCGCCGCCTCTTCGGCCCAGTGGACAGCGAGC
AGCTGAGCCGCGACTGTGATGCGCTAATGGCGGGCTGCATCCAGGAGGCCCGTGAGCGATGGAACTTCGA
CTTTGTCACCGAGACACCACTGGAGGGTGACTTCGCCTGGGAGCGTGTGCGGGCCTTGGCCTGCCCAAG
CTCTACCTTCCCACGGGCCCCGGCGAGGCCGGGATGAGTTGGGAGGAGGCAGGCGGCCTGGCACCTCAC
CTGCTCTGCTGCAGGGACAGCAGAGGAAGACCATGTGGACCTGTCACTGTCTTGTACCCTTGTGCCTCG
CTCAGGGGAGCAGGCTGAAGGGTCCCCAGGTGGACCTGGAGACTCTCAGGGTCGAAAACGGCGGCAGACC
AGCATGACAGATTTCTACCACTCCAAACGCCGGCTGATCTTCTCCAAGAGGAAGCCCTAATCCGCCCACA
GGAAGCCTGCAGTCCTGGAAGCGCGAGGGCCTCAAAGGCCCGCTCTACATCTTCTGCCTTAGTCTCAGTT
TGTGTGTCTTAATTATTATTTGTGTTTTAATTTAAACACCTCCTCATGTACATACCCTGGCCGCCCCTG
CCCCCCAGCCTCTGGCATTAGAATTATTTAAACAAAAACTAGGCGGTTGAATGAGAGGTTCCTAAGAGTG
CTGGGCATTTTTATTTTATGAAATACTATTTAAAGCCTCCTCATCCCGTGTTCTCCTTTTCCTCTCTCCC
GGAGGTTGGGTGGGCCGGCTTCATGCCAGCTACTTCCTCCTCCCACTTGTCCGCTGGGTGGTACCCTCT
GGAGGGGTGTGGCTCCTTCCCATCGCTGTCACAGGCGGTTATGAAATTCACCCCCTTTCCTGGACACTCA
GACCTGAATTCTTTTTCATTTGAGAAGTAAACAGATGGCACTTTGAAGGGCCTCACCGAGTGGGGCAT
CATCAAAAACTTTGGAGTCCCCTCACCTCCTCTAAGGTTGGGCAGGGTGACCCTGAAGTGAGCACAGCCT
AGGGCTGAGCTGGGGACCTGGTACCCTCCTGGCTCTTGATACCCCCTCTGTCTTGTGAAGGCAGGGGGA
AGGTGGGGTCCTGGAGCAGACCACCCCGCCTGCCCTCATGGCCCTCTGACCTGCACTGGGGAGCCCGTC
TCAGTGTTGAGCCTTTTCCCTCTTTGGCTCCCCTGTACCTTTTGAGGAGCCCCAGCTACCCTTCTTCTCC
AGCTGGGCTCTGCAATTCCCCTCTGCTGCTGTCCCTCCCCCTTGTCCTTTCCCTTCAGTACCCTCTCAGC
TCCAGGTGGCTCTGAGGTGCCTGTCCCACCCCCACCCCCAGCTCAATGGACTGGAAGGGGAAGGGACACA
CAAGAAGAAGGGCACCCTAGTTCTACCTCAGGCAGCTCAAGCAGCGACCGCCCCCTCCTCTAGCTGTGGG
GGTGAGGGTCCCATGTGGTGGCACAGGCCCCCTTGAGTGGGGTTATCTCTGTGTTAGGGGTATATGATGG
GGGAGTAGATCTTTCTAGGAGGGAGACACTGGCCCCTCAAATCGTCCAGCGACCTTCCTCATCCACCCCA
TCCCTCCCCAGTTCATTGCACTTTGATTAGCAGCGGAACAAGGAGTCAGACATTTTAAGATGGTGGCAGT
AGAGGCTATGGACAGGGCATGCCACGTGGGCTCATATGGGGCTGGGAGTAGTTGTCTTTCCTGGCACTAA
CGTTGAGCCCCTGGAGGCACTGAAGTGCTTAGTGTACTTGGAGTATTGGGGTCTGACCCCAAACACCTTC
CAGCTCCTGTAACATACTGGCCTGGACTGTTTTCTCTCGGCTCCCCATGTGTCCTGGTTCCGTTTCTCC
ACCTAGACTGTAAACCTCTCGAGGGCAGGGACCACACCCTGTACTGTTCTGTGTCTTTCACAGCTCCTCC
CACAATGCTGAATATACAGCAGGTGCTCAATAAATGATTCTTAGTGACTTTACTTGTAAAAAAAAAAAAA
AAAAA
```

FIG. 1

RNA AGENTS FOR P21 GENE MODULATION

SEQUENCE LISTING

This application includes a Sequence Listing submitted electronically as an ASCII file created on Dec. 23, 2015, named ND5123458US_SL.txt, which is 1,311,345 bytes in size, and is hereby incorporated by reference in its entirety.

BACKGROUND OF THE INVENTION p21 is a cell cycle-regulating protein that is encoded by CDKN1A gene and belongs to the CIP/KIP family. This protein has the function of inhibiting cell cycle progression at the G1 phase and the G2/M phase by inhibiting the effect of a cyclin-CDK complex through binding to the complex. Specifically, the p21 gene undergoes activation by p53, one of tumor suppressor genes. It has been reported that upon activation of p53 due to DNA damage or the like, p53 activates p21 so that the cell cycle is arrested at the G1 phase and the G2/M phase.

p21 is overexpressed in a variety of human cancers including prostate, cervical, breast and squamous cell carcinomas and, in many cases, p21 upregulation correlates positively with tumor grade, invasiveness and aggressiveness. See, e.g., Chang et al., Proc. Natl. Acad. Sci. USA, 2000, Vol. 97, No. 8, pp. 4291-96. Also, up-regulation of p21 has been reported to be associated with tumorigenicity and poor prognosis in many forms of cancers, including brain, prostate, ovarian, breast, and esophageal cell cancers. See, e.g., Winters et al., Breast Cancer Research, 2003, Vol. 5, No. 6, pp. R242-R249. Also, the disease can be age related diseases, including atherosclerosis, Alzheimer's disease, amyloidosis, and arthritis. See, e.g., Chang et al., Proc. Natl. Acad. Sci. USA, 2000, Vol. 97, No. 8, pp. 4291-96.

Therapeutics for inhibition of p21 expression will require highly potent siRNA sequences and structures.

What is needed are siRNA sequences, compounds and structures for inhibition of p21 expression.

BRIEF SUMMARY

This invention relates to the fields of biopharmaceuticals and therapeutics composed of nucleic acid based molecules. More particularly, this invention relates to compounds and compositions utilizing RNA interference (RNAi) for modulating the expression of human p21.

This invention relates to compounds, compositions and methods for modulating the expression of human p21 using RNA interference.

In some embodiments, this invention provides molecules for RNA interference gene silencing of p21.

In further embodiments, the structures, molecules and compositions of this invention can be used in methods for preventing or treating diseases, or ameliorating symptoms of conditions or disorders associated with p21, including malignant tumor.

Embodiments of this invention include the following:

A nucleic acid molecule, where a) the molecule has a polynucleotide sense strand and a polynucleotide antisense strand; b) each strand of the molecule is from 15 to 30 nucleotides in length; c) a contiguous region of from 15 to 30 nucleotides of the antisense strand is complementary to a sequence of an mRNA encoding p21; and d) at least a portion of the sense strand is complementary to at least a portion of the antisense strand, and the molecule has a duplex region of from 15 to 30 nucleotides in length.

In some embodiments, the nucleic acid molecule can have a contiguous region of from 15 to 30 nucleotides of the antisense strand that is complementary to a sequence of an mRNA encoding p21, and is located in the duplex region of the molecule.

In additional embodiments, the nucleic acid molecule can have a contiguous region of from 15 to 30 nucleotides of the antisense strand that is complementary to a sequence of an mRNA encoding p21, and is selected from a sequence of human p21 mRNA in SEQ ID NO:1.

Embodiments of this invention provide nucleic acid molecules having a contiguous region of from 15 to 30 nucleotides of the antisense strand that is complementary to a sequence of an mRNA encoding p21, and is selected from a sequence of human p21, wherein the sequence of human p21 is selected from the group of positions 1 to 125 of SEQ ID NO:1, positions 126 to 620 of SEQ ID NO:1, and positions 621 to 2175 of SEQ ID NO:1.

In certain embodiments, a nucleic acid molecule can have an antisense strand that contains a sequence selected from SEQ ID NOs:2033 to 4063. In further embodiments, a nucleic acid molecule can have an antisense strand that contains a sequence selected from SEQ ID NOs:4092 to 4119.

Nucleic acid molecules of this invention can be composed of a sense and antisense strand pair selected from the group of SEQ ID NO:4066 and 4094, SEQ ID NO:4067 and 4095, SEQ ID NO:4068 and 4096, SEQ ID NO:4073 and 4101, SEQ ID NO:4075 and 4103, SEQ ID NO:4080 and 4108, SEQ ID NO:4084 and 4112, SEQ ID NO:4085 and 4113, SEQ ID NO:4088 and 4116, and SEQ ID NO:4091 and 4119.

In further aspects, a nucleic acid molecule of this invention can have each strand of the molecule being from 18 to 22 nucleotides in length. A nucleic acid molecule can have a duplex region of 19 nucleotides in length.

In certain embodiments, a nucleic acid molecule can have a polynucleotide sense strand and the polynucleotide antisense strand that are connected as a single strand, and form a duplex region connected at one end by a loop.

The nucleic acid molecules of this invention can have a blunt end, and can have one or more 3' overhangs.

The nucleic acid molecules of this invention can be RNAi molecules that are active for gene silencing, for example, a dsRNA that is active for gene silencing, a siRNA, a micro-RNA, or a shRNA active for gene silencing, as well as a DNA-directed RNA (ddRNA), a Piwi-interacting RNA (piRNA), and a repeat associated siRNA (rasiRNA).

This invention provides a range of nucleic acid molecules that are active for inhibiting expression of p21. In some embodiments, the nucleic acid molecule can have an IC50 for knockdown of p21 of less than 100 pM.

This invention further contemplates compositions containing one or more inventive nucleic acid molecules and a pharmaceutically acceptable carrier. The carrier can be a lipid molecule or liposome.

In further aspects, this invention includes methods for treating a disease associated with p21 expression, by administering to a subject in need a composition containing one or more inventive nucleic acid molecules. The disease can be malignant tumor, which may be presented in a disease such as cancers associated with p21 expression, among others.

BRIEF DESCRIPTION OF THE DRAWINGS

FIG. 1 shows SEQ ID NO: 1, which is the nucleic acid sequence of an example target p21 mRNA, disclosed in GenBank accession number NM_000389.4 (CDKN1A), which is 2175 nucleotides in length.

DETAILED DESCRIPTION OF THE INVENTION

Figure 2:
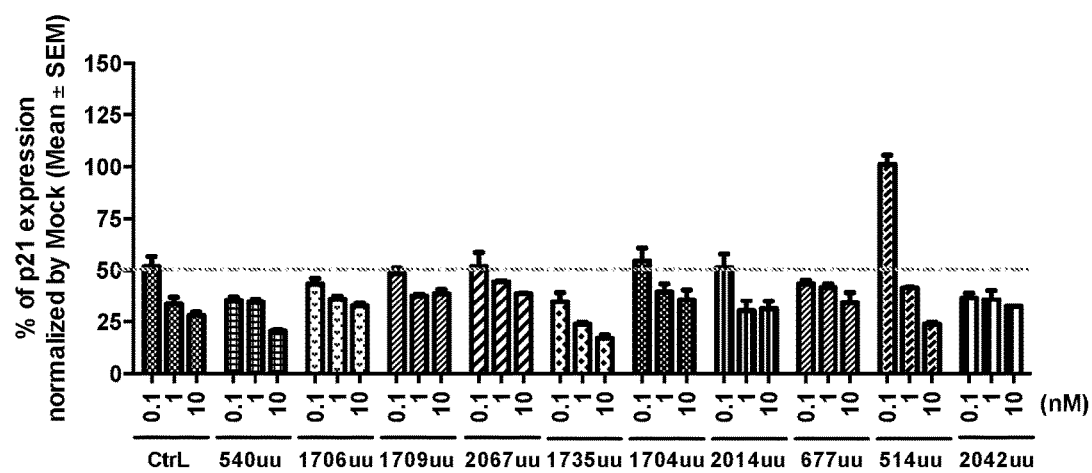
FIG. 2 shows p21 siRNAs tested for ability to down regulate p21 mRNA in A549 cells. A549 cells were plated at 2000/well, 24 hours before transfection. Cells were then transfected with p21 siRNAs at 0.1, 1, and 10 nM concentrations for 24 hours. The fold change of p21 expression level was measured using qRT-PCR (n=3).

This invention relates to compounds, compositions and methods for nucleic acid based therapeutics for modulating expression of p21.

In some embodiments, this invention provides molecules active in RNA interference, as well as structures and compositions that can silence expression of p21.

The structures and compositions of this disclosure can be used in preventing or treating various diseases such as malignant tumor.

In further embodiments, this invention provides compositions for delivery and uptake of one or more therapeutic RNAi molecules of this invention, as well as methods of use thereof. The RNA-based compositions of this invention can be used in methods for preventing or treating malignant tumors, such as cancers.

Therapeutic compositions of this invention include nucleic acid molecules that are active in RNA interference. The therapeutic nucleic acid molecules can be targeted to CDKN1A (p21) for gene silencing.

In various embodiments, this invention provides a range of molecules that can be active as a small interfering RNA (siRNA), and can regulate or silence p21 expression.

The siRNAs of this invention can be used for preventing or treating malignant tumors.

Embodiments of this invention further provide a vehicle, formulation, or lipid nanoparticle formulation for delivery of the inventive siRNAs to subjects in need of preventing or treating a malignant tumor. This invention further contemplates methods for administering siRNAs as therapeutics to mammals.

The therapeutic molecules and compositions of this invention can be used for RNA interference directed to preventing or treating a p21 associated disease, by administering a compound or composition to a subject in need.

The methods of this invention can utilize the inventive compounds for preventing or treating malignant tumor. The malignant tumor can be presented in various diseases, for example, cancers that highly expressing p21, sarcomas, fibrosarcoma, malignant fibrous histiocytoma, liposarcoma, rhabdomyosarcoma, leiomyosarcoma, angiosarcoma, Kaposi's sarcoma, lymphangiosarcoma, synovial sarcoma, chondrosarcoma, osteosarcoma, carcinomas, brain tumor, head and neck cancer, breast cancer, lung cancer, esophageal cancer, stomach cancer, duodenal cancer, appendix cancer, colorectal cancer, rectal cancer, liver cancer, pancreatic cancer, gallbladder cancer, bile duct cancer, anus cancer, kidney cancer, urethral cancer, urinary bladder cancer, prostate cancer, testicular cancer, uterine cancer, ovary cancer, skin cancer, leukemia, malignant lymphoma, epithelial malignant tumors, and non-epithelial malignant tumors.

In certain embodiments, a combination of therapeutic molecules of this invention can be used for silencing or inhibiting p21 gene expression.

This invention provides a range of RNAi molecules, where each molecule has a polynucleotide sense strand and a polynucleotide antisense strand; each strand of the molecule is from 15 to 30 nucleotides in length; a contiguous region of from 15 to 30 nucleotides of the antisense strand is complementary to a sequence of an mRNA encoding p21; and at least a portion of the sense strand is complementary to at least a portion of the antisense strand, and the molecule has a duplex region of from 15 to 30 nucleotides in length.

A RNAi molecule of this invention can have a contiguous region of from 15 to 30 nucleotides of the antisense strand that is complementary to a sequence of an mRNA encoding p21, which is located in the duplex region of the molecule.

In some embodiments, a RNAi molecule can have a contiguous region of from 15 to 30 nucleotides of the antisense strand that is complementary to a sequence of an mRNA encoding p21.

Embodiments of this invention may further provide methods for preventing, treating or ameliorating one or more symptoms of malignant tumor, or reducing the risk of developing malignant tumor, or delaying the onset of malignant tumor in a mammal in need thereof.

P21 and RNAi Molecules p21 is present in various animals including humans. Sequence information for human CDKN1A (p21) is found at: NM_000389.4, NM_078467.2, NM_001291549.1, NM_001220778.1, NM_001220777.1 (NP_001207707.1, NP_001278478.1, NP_001207706.1, NP_510867.1, NP_000380.1).

FIG. 1 shows the nucleic acid sequence of an example target human p21 mRNA, which is disclosed in GenBank accession number NM_000389.4 (CDKN1A), and is 2175 base pairs in length (SEQ ID NO: 1).

One of ordinary skill in the art would understand that a reported sequence may change over time and to incorporate any changes needed in the nucleic acid molecules herein accordingly.

Embodiments of this invention can provide compositions and methods for gene silencing of p21 expression using small nucleic acid molecules. Examples of nucleic acid molecules include molecules active in RNA interference (RNAi molecules), short interfering RNA (siRNA), microRNA (miRNA), and short hairpin RNA (shRNA) molecules, as well as DNA-directed RNA (ddRNA), Piwi-interacting RNA (piRNA), and repeat associated siRNA (rasiRNA). Such molecules are capable of mediating RNA interference against p21 gene expression.

The composition and methods disclosed herein can also be used in treating various kinds of malignant tumors in a subject.

The nucleic acid molecules and methods of this invention may be used to down regulate the expression of genes that encode p21.

The compositions and methods of this invention can include one or more nucleic acid molecules, which, independently or in combination, can modulate or regulate the expression of p21 protein and/or genes encoding p21 proteins, proteins and/or genes encoding p21 associated with the maintenance and/or development of diseases, conditions or disorders associated with p21, such as malignant tumor.

The compositions and methods of this invention are described with reference to exemplary sequences of p21. A person of ordinary skill in the art would understand that various aspects and embodiments of the invention are directed to any related p21 genes, sequences, or variants, such as homolog genes and transcript variants, and polymorphisms, including single nucleotide polymorphism (SNP) associated with any p21 genes.

In some embodiments, the compositions and methods of this invention can provide a double-stranded short interfering nucleic acid (siRNA) molecule that downregulates the expression of a p21 gene, for example human CDKN1A.

A RNAi molecule of this invention can be targeted to p21 and any homologous sequences, for example, using complementary sequences or by incorporating non-canonical base pairs, for example, mismatches and/or wobble base pairs, that can provide additional target sequences.

In instances where mismatches are identified, non-canonical base pairs, for example, mismatches and/or wobble bases can be used to generate nucleic acid molecules that target more than one gene sequence.

For example, non-canonical base pairs such as UU and CC base pairs can be used to generate nucleic acid molecules that are capable of targeting sequences for differing p21 targets that share sequence homology. Thus, a RNAi molecule can be targeted to a nucleotide sequence that is conserved between homologous genes, and a single RNAi molecule can be used to inhibit expression of more than one gene.

In some aspects, the compositions and methods of this invention include RNAi molecules that are active against p21 mRNA, where the RNAi molecule includes a sequence complementary to any mRNA encoding a p21 sequence.

In some embodiments, a RNAi molecule of this disclosure can have activity against p21 RNA, where the RNAi molecule includes a sequence complementary to an RNA having a variant p21 encoding sequence, for example, a mutant p21 gene known in the art to be associated with malignant tumor.

In further embodiments, a RNAi molecule of this invention can include a nucleotide sequence that can interact with a nucleotide sequence of a p21 gene and mediate silencing of p21 gene expression.

Examples of RNAi molecules of this invention targeted to p21 mRNA are shown in Tables 1 and 2.

TABLE 1

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 126 | 2 | AUGUCAGAACCGGCUGGGGmUmU | 2033 | CCCCAGCCGGUUCUGACAUmUmU |
| 127 | 3 | UGUCAGAACCGGCUGGGGAmUmU | 2034 | UCCCCAGCCGGUUCUGACAmUmU |
| 128 | 4 | GUCAGAACCGGCUGGGGAUmUmU | 2035 | AUCCCCAGCCGGUUCUGACmUmU |
| 129 | 5 | UCAGAACCGGCUGGGGAUGmUmU | 2036 | CAUCCCCAGCCGGUUCUGAmUmU |
| 130 | 6 | CAGAACCGGCUGGGGAUGUmUmU | 2037 | ACAUCCCCAGCCGGUUCUGmUmU |
| 131 | 7 | AGAACCGGCUGGGGAUGUCmUmU | 2038 | GACAUCCCCAGCCGGUUCUmUmU |
| 132 | 8 | GAACCGGCUGGGGAUGUCCmUmU | 2039 | GGACAUCCCCAGCCGGUUCmUmU |
| 133 | 9 | AACCGGCUGGGGAUGUCCGmUmU | 2040 | CGGACAUCCCCAGCCGGUUmUmU |
| 134 | 10 | ACCGGCUGGGGAUGUCCGUmUmU | 2041 | ACGGACAUCCCCAGCCGGUmUmU |
| 135 | 11 | CCGGCUGGGGAUGUCCGUCmUmU | 2042 | GACGGACAUCCCCAGCCGGmUmU |
| 136 | 12 | CGGCUGGGGAUGUCCGUCAmUmU | 2043 | UGACGGACAUCCCCAGCCGmUmU |
| 137 | 13 | GGCUGGGGAUGUCCGUCAGmUmU | 2044 | CUGACGGACAUCCCCAGCCmUmU |
| 138 | 14 | GCUGGGGAUGUCCGUCAGAmUmU | 2045 | UCUGACGGACAUCCCCAGCmUmU |
| 139 | 15 | CUGGGGAUGUCCGUCAGAAmUmU | 2046 | UUCUGACGGACAUCCCCAGmUmU |
| 140 | 16 | UGGGGAUGUCCGUCAGAACmUmU | 2047 | GUUCUGACGGACAUCCCCAmUmU |
| 141 | 17 | GGGGAUGUCCGUCAGAACCmUmU | 2048 | GGUUCUGACGGACAUCCCCmUmU |
| 142 | 18 | GGGAUGUCCGUCAGAACCCmUmU | 2049 | GGGUUCUGACGGACAUCCCmUmU |
| 143 | 19 | GGAUGUCCGUCAGAACCCAmUmU | 2050 | UGGGUUCUGACGGACAUCCmUmU |
| 144 | 20 | GAUGUCCGUCAGAACCCAUmUmU | 2051 | AUGGGUUCUGACGGACAUCmUmU |
| 145 | 21 | AUGUCCGUCAGAACCCAUGmUmU | 2052 | CAUGGGUUCUGACGGACAUmUmU |
| 146 | 22 | UGUCCGUCAGAACCCAUGCmUmU | 2053 | GCAUGGGUUCUGACGGACAmUmU |
| 147 | 23 | GUCCGUCAGAACCCAUGCGmUmU | 2054 | CGCAUGGGUUCUGACGGACmUmU |
| 148 | 24 | UCCGUCAGAACCCAUGCGGmUmU | 2055 | CCGCAUGGGUUCUGACGGAmUmU |
| 149 | 25 | CCGUCAGAACCCAUGCGGCmUmU | 2056 | GCCGCAUGGGUUCUGACGGmUmU |
| 150 | 26 | CGUCAGAACCCAUGCGGCAmUmU | 2057 | UGCCGCAUGGGUUCUGACGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 151 | 27 | GUCAGAACCCAUGCGGCAGmUmU | 2058 | CUGCCGCAUGGGUUCUGACmUmU |
| 152 | 28 | UCAGAACCCAUGCGGCAGCmUmU | 2059 | GCUGCCGCAUGGGUUCUGAmUmU |
| 153 | 29 | CAGAACCCAUGCGGCAGCAmUmU | 2060 | UGCUGCCGCAUGGGUUCUGmUmU |
| 154 | 30 | AGAACCCAUGCGGCAGCAAmUmU | 2061 | UUGCUGCCGCAUGGGUUCUmUmU |
| 155 | 31 | GAACCCAUGCGGCAGCAAGmUmU | 2062 | CUUGCUGCCGCAUGGGUUCmUmU |
| 156 | 32 | AACCCAUGCGGCAGCAAGGmUmU | 2063 | CCUUGCUGCCGCAUGGGUUmUmU |
| 157 | 33 | ACCCAUGCGGCAGCAAGGCmUmU | 2064 | GCCUUGCUGCCGCAUGGGUmUmU |
| 158 | 34 | CCCAUGCGGCAGCAAGGCCmUmU | 2065 | GGCCUUGCUGCCGCAUGGGmUmU |
| 159 | 35 | CCAUGCGGCAGCAAGGCCUmUmU | 2066 | AGGCCUUGCUGCCGCAUGGmUmU |
| 160 | 36 | CAUGCGGCAGCAAGGCCUGmUmU | 2067 | CAGGCCUUGCUGCCGCAUGmUmU |
| 161 | 37 | AUGCGGCAGCAAGGCCUGCmUmU | 2068 | GCAGGCCUUGCUGCCGCAUmUmU |
| 162 | 38 | UGCGGCAGCAAGGCCUGCCmUmU | 2069 | GGCAGGCCUUGCUGCCGCAmUmU |
| 163 | 39 | GCGGCAGCAAGGCCUGCCGmUmU | 2070 | CGGCAGGCCUUGCUGCCGCmUmU |
| 164 | 40 | CGGCAGCAAGGCCUGCCGCmUmU | 2071 | GCGGCAGGCCUUGCUGCCGmUmU |
| 165 | 41 | GGCAGCAAGGCCUGCCGCCmUmU | 2072 | GGCGGCAGGCCUUGCUGCCmUmU |
| 166 | 42 | GCAGCAAGGCCUGCCGCCGmUmU | 2073 | CGGCGGCAGGCCUUGCUGCmUmU |
| 167 | 43 | CAGCAAGGCCUGCCGCCGCmUmU | 2074 | GCGGCGGCAGGCCUUGCUGmUmU |
| 168 | 44 | AGCAAGGCCUGCCGCCGCCmUmU | 2075 | GGCGGCGGCAGGCCUUGCUmUmU |
| 169 | 45 | GCAAGGCCUGCCGCCGCCUmUmU | 2076 | AGGCGGCGGCAGGCCUUGCmUmU |
| 170 | 46 | CAAGGCCUGCCGCCGCCUCmUmU | 2077 | GAGGCGGCGGCAGGCCUUGmUmU |
| 171 | 47 | AAGGCCUGCCGCCGCCUCUmUmU | 2078 | AGAGGCGGCGGCAGGCCUUmUmU |
| 172 | 48 | AGGCCUGCCGCCGCCUCUUmUmU | 2079 | AAGAGGCGGCGGCAGGCCUmUmU |
| 173 | 49 | GGCCUGCCGCCGCCUCUUCmUmU | 2080 | GAAGAGGCGGCGGCAGGCCmUmU |
| 174 | 50 | GCCUGCCGCCGCCUCUUCGmUmU | 2081 | CGAAGAGGCGGCGGCAGGCmUmU |
| 175 | 51 | CCUGCCGCCGCCUCUUCGGmUmU | 2082 | CCGAAGAGGCGGCGGCAGGmUmU |
| 176 | 52 | CUGCCGCCGCCUCUUCGGCmUmU | 2083 | GCCGAAGAGGCGGCGGCAGmUmU |
| 177 | 53 | UGCCGCCGCCUCUUCGGCCmUmU | 2084 | GGCCGAAGAGGCGGCGGCAmUmU |
| 178 | 54 | GCCGCCGCCUCUUCGGCCCmUmU | 2085 | GGGCCGAAGAGGCGGCGGCmUmU |
| 179 | 55 | CCGCCGCCUCUUCGGCCCAmUmU | 2086 | UGGGCCGAAGAGGCGGCGGmUmU |
| 180 | 56 | CGCCGCCUCUUCGGCCCAGmUmU | 2087 | CUGGGCCGAAGAGGCGGCGmUmU |
| 181 | 57 | GCCGCCUCUUCGGCCCAGUmUmU | 2088 | ACUGGGCCGAAGAGGCGGCmUmU |
| 182 | 58 | CCGCCUCUUCGGCCCAGUGmUmU | 2089 | CACUGGGCCGAAGAGGCGGmUmU |
| 183 | 59 | CGCCUCUUCGGCCCAGUGGmUmU | 2090 | CCACUGGGCCGAAGAGGCGmUmU |
| 184 | 60 | GCCUCUUCGGCCCAGUGGAmUmU | 2091 | UCCACUGGGCCGAAGAGGCmUmU |
| 185 | 61 | CCUCUUCGGCCCAGUGGACmUmU | 2092 | GUCCACUGGGCCGAAGAGGmUmU |
| 186 | 62 | CUCUUCGGCCCAGUGGACAmUmU | 2093 | UGUCCACUGGGCCGAAGAGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 187 | 63 | UCUUCGGCCCAGUGGACAGmUmU | 2094 | CUGUCCACUGGGCCGAAGAmUmU |
| 188 | 64 | CUUCGGCCCAGUGGACAGCmUmU | 2095 | GCUGUCCACUGGGCCGAAGmUmU |
| 189 | 65 | UUCGGCCCAGUGGACAGCGmUmU | 2096 | CGCUGUCCACUGGGCCGAAmUmU |
| 190 | 66 | UCGGCCCAGUGGACAGCGAmUmU | 2097 | UCGCUGUCCACUGGGCCGAmUmU |
| 191 | 67 | CGGCCCAGUGGACAGCGAGmUmU | 2098 | CUCGCUGUCCACUGGGCCGmUmU |
| 192 | 68 | GGCCCAGUGGACAGCGAGCmUmU | 2099 | GCUCGCUGUCCACUGGGCCmUmU |
| 193 | 69 | GCCCAGUGGACAGCGAGCAmUmU | 2100 | UGCUCGCUGUCCACUGGGCmUmU |
| 194 | 70 | CCCAGUGGACAGCGAGCAGmUmU | 2101 | CUGCUCGCUGUCCACUGGGmUmU |
| 195 | 71 | CCAGUGGACAGCGAGCAGCmUmU | 2102 | GCUGCUCGCUGUCCACUGGmUmU |
| 196 | 72 | CAGUGGACAGCGAGCAGCUmUmU | 2103 | AGCUGCUCGCUGUCCACUGmUmU |
| 197 | 73 | AGUGGACAGCGAGCAGCUGmUmU | 2104 | CAGCUGCUCGCUGUCCACUmUmU |
| 198 | 74 | GUGGACAGCGAGCAGCUGAmUmU | 2105 | UCAGCUGCUCGCUGUCCACmUmU |
| 199 | 75 | UGGACAGCGAGCAGCUGAGmUmU | 2106 | CUCAGCUGCUCGCUGUCCAmUmU |
| 200 | 76 | GGACAGCGAGCAGCUGAGCmUmU | 2107 | GCUCAGCUGCUCGCUGUCCmUmU |
| 201 | 77 | GACAGCGAGCAGCUGAGCCmUmU | 2108 | GGCUCAGCUGCUCGCUGUCmUmU |
| 202 | 78 | ACAGCGAGCAGCUGAGCCGmUmU | 2109 | CGGCUCAGCUGCUCGCUGUmUmU |
| 203 | 79 | CAGCGAGCAGCUGAGCCGCmUmU | 2110 | GCGGCUCAGCUGCUCGCUGmUmU |
| 204 | 80 | AGCGAGCAGCUGAGCCGCGmUmU | 2111 | CGCGGCUCAGCUGCUCGCUmUmU |
| 205 | 81 | GCGAGCAGCUGAGCCGCGAmUmU | 2112 | UCGCGGCUCAGCUGCUCGCmUmU |
| 206 | 82 | CGAGCAGCUGAGCCGCGACmUmU | 2113 | GUCGCGGCUCAGCUGCUCGmUmU |
| 207 | 83 | GAGCAGCUGAGCCGCGACUmUmU | 2114 | AGUCGCGGCUCAGCUGCUCmUmU |
| 208 | 84 | AGCAGCUGAGCCGCGACUGmUmU | 2115 | CAGUCGCGGCUCAGCUGCUmUmU |
| 209 | 85 | GCAGCUGAGCCGCGACUGUmUmU | 2116 | ACAGUCGCGGCUCAGCUGCmUmU |
| 210 | 86 | CAGCUGAGCCGCGACUGUGmUmU | 2117 | CACAGUCGCGGCUCAGCUGmUmU |
| 211 | 87 | AGCUGAGCCGCGACUGUGAmUmU | 2118 | UCACAGUCGCGGCUCAGCUmUmU |
| 212 | 88 | GCUGAGCCGCGACUGUGAUmUmU | 2119 | AUCACAGUCGCGGCUCAGCmUmU |
| 213 | 89 | CUGAGCCGCGACUGUGAUGmUmU | 2120 | CAUCACAGUCGCGGCUCAGmUmU |
| 214 | 90 | UGAGCCGCGACUGUGAUGCmUmU | 2121 | GCAUCACAGUCGCGGCUCAmUmU |
| 215 | 91 | GAGCCGCGACUGUGAUGCGmUmU | 2122 | CGCAUCACAGUCGCGGCUCmUmU |
| 216 | 92 | AGCCGCGACUGUGAUGCGCmUmU | 2123 | GCGCAUCACAGUCGCGGCUmUmU |
| 217 | 93 | GCCGCGACUGUGAUGCGCUmUmU | 2124 | AGCGCAUCACAGUCGCGGCmUmU |
| 218 | 94 | CCGCGACUGUGAUGCGCUAmUmU | 2125 | UAGCGCAUCACAGUCGCGGmUmU |
| 219 | 95 | CGCGACUGUGAUGCGCUAAmUmU | 2126 | UUAGCGCAUCACAGUCGCGmUmU |
| 220 | 96 | GCGACUGUGAUGCGCUAAUmUmU | 2127 | AUUAGCGCAUCACAGUCGCmUmU |
| 221 | 97 | CGACUGUGAUGCGCUAAUGmUmU | 2128 | CAUUAGCGCAUCACAGUCGmUmU |
| 222 | 98 | GACUGUGAUGCGCUAAUGGmUmU | 2129 | CCAUUAGCGCAUCACAGUCmUmU |
| 223 | 99 | ACUGUGAUGCGCUAAUGGCmUmU | 2130 | GCCAUUAGCGCAUCACAGUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 224 | 100 | CUGUGAUGCGCUAAUGGCGmUmU | 2131 | CGCCAUUAGCGCAUCACAGmUmU |
| 225 | 101 | UGUGAUGCGCUAAUGGCGGmUmU | 2132 | CCGCCAUUAGCGCAUCACAmUmU |
| 226 | 102 | GUGAUGCGCUAAUGGCGGGmUmU | 2133 | CCCGCCAUUAGCGCAUCACmUmU |
| 227 | 103 | UGAUGCGCUAAUGGCGGGCmUmU | 2134 | GCCCGCCAUUAGCGCAUCAmUmU |
| 228 | 104 | GAUGCGCUAAUGGCGGGCUmUmU | 2135 | AGCCCGCCAUUAGCGCAUCmUmU |
| 229 | 105 | AUGCGCUAAUGGCGGGCUGmUmU | 2136 | CAGCCCGCCAUUAGCGCAUmUmU |
| 230 | 106 | UGCGCUAAUGGCGGGCUGCmUmU | 2137 | GCAGCCCGCCAUUAGCGCAmUmU |
| 231 | 107 | GCGCUAAUGGCGGGCUGCAmUmU | 2138 | UGCAGCCCGCCAUUAGCGCmUmU |
| 232 | 108 | CGCUAAUGGCGGGCUGCAUmUmU | 2139 | AUGCAGCCCGCCAUUAGCGmUmU |
| 233 | 109 | GCUAAUGGCGGGCUGCAUCmUmU | 2140 | GAUGCAGCCCGCCAUUAGCmUmU |
| 234 | 110 | CUAAUGGCGGGCUGCAUCCmUmU | 2141 | GGAUGCAGCCCGCCAUUAGmUmU |
| 235 | 111 | UAAUGGCGGGCUGCAUCCAmUmU | 2142 | UGGAUGCAGCCCGCCAUUAmUmU |
| 236 | 112 | AAUGGCGGGCUGCAUCCAGmUmU | 2143 | CUGGAUGCAGCCCGCCAUUmUmU |
| 237 | 113 | AUGGCGGGCUGCAUCCAGGmUmU | 2144 | CCUGGAUGCAGCCCGCCAUmUmU |
| 238 | 114 | UGGCGGGCUGCAUCCAGGAmUmU | 2145 | UCCUGGAUGCAGCCCGCCAmUmU |
| 239 | 115 | GGCGGGCUGCAUCCAGGAGmUmU | 2146 | CUCCUGGAUGCAGCCCGCCmUmU |
| 240 | 116 | GCGGGCUGCAUCCAGGAGGmUmU | 2147 | CCUCCUGGAUGCAGCCCGCmUmU |
| 241 | 117 | CGGGCUGCAUCCAGGAGGCmUmU | 2148 | GCCUCCUGGAUGCAGCCCGmUmU |
| 242 | 118 | GGGCUGCAUCCAGGAGGCCmUmU | 2149 | GGCCUCCUGGAUGCAGCCCmUmU |
| 243 | 119 | GGCUGCAUCCAGGAGGCCCmUmU | 2150 | GGGCCUCCUGGAUGCAGCCmUmU |
| 244 | 120 | GCUGCAUCCAGGAGGCCCGmUmU | 2151 | CGGGCCUCCUGGAUGCAGCmUmU |
| 245 | 121 | CUGCAUCCAGGAGGCCCGUmUmU | 2152 | ACGGGCCUCCUGGAUGCAGmUmU |
| 246 | 122 | UGCAUCCAGGAGGCCCGUGmUmU | 2153 | CACGGGCCUCCUGGAUGCAmUmU |
| 247 | 123 | GCAUCCAGGAGGCCCGUGAmUmU | 2154 | UCACGGGCCUCCUGGAUGCmUmU |
| 248 | 124 | CAUCCAGGAGGCCCGUGAGmUmU | 2155 | CUCACGGGCCUCCUGGAUGmUmU |
| 249 | 125 | AUCCAGGAGGCCCGUGAGCmUmU | 2156 | GCUCACGGGCCUCCUGGAUmUmU |
| 250 | 126 | UCCAGGAGGCCCGUGAGCGmUmU | 2157 | CGCUCACGGGCCUCCUGGAmUmU |
| 251 | 127 | CCAGGAGGCCCGUGAGCGAmUmU | 2158 | UCGCUCACGGGCCUCCUGGmUmU |
| 252 | 128 | CAGGAGGCCCGUGAGCGAUmUmU | 2159 | AUCGCUCACGGGCCUCCUGmUmU |
| 253 | 129 | AGGAGGCCCGUGAGCGAUGmUmU | 2160 | CAUCGCUCACGGGCCUCCUmUmU |
| 254 | 130 | GGAGGCCCGUGAGCGAUGGmUmU | 2161 | CCAUCGCUCACGGGCCUCCmUmU |
| 255 | 131 | GAGGCCCGUGAGCGAUGGAmUmU | 2162 | UCCAUCGCUCACGGGCCUCmUmU |
| 256 | 132 | AGGCCCGUGAGCGAUGGAAmUmU | 2163 | UUCCAUCGCUCACGGGCCUmUmU |
| 257 | 133 | GGCCCGUGAGCGAUGGAACmUmU | 2164 | GUUCCAUCGCUCACGGGCCmUmU |
| 258 | 134 | GCCCGUGAGCGAUGGAACUmUmU | 2165 | AGUUCCAUCGCUCACGGGCmUmU |
| 259 | 135 | CCCGUGAGCGAUGGAACUUmUmU | 2166 | AAGUUCCAUCGCUCACGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 260 | 136 | CCGUGAGCGAUGGAACUUCmUmU | 2167 | GAAGUUCCAUCGCUCACGGmUmU |
| 261 | 137 | CGUGAGCGAUGGAACUUCGmUmU | 2168 | CGAAGUUCCAUCGCUCACGmUmU |
| 262 | 138 | GUGAGCGAUGGAACUUCGAmUmU | 2169 | UCGAAGUUCCAUCGCUCACmUmU |
| 263 | 139 | UGAGCGAUGGAACUUCGACmUmU | 2170 | GUCGAAGUUCCAUCGCUCAmUmU |
| 264 | 140 | GAGCGAUGGAACUUCGACUmUmU | 2171 | AGUCGAAGUUCCAUCGCUCmUmU |
| 265 | 141 | AGCGAUGGAACUUCGACUUmUmU | 2172 | AAGUCGAAGUUCCAUCGCUmUmU |
| 266 | 142 | GCGAUGGAACUUCGACUUUmUmU | 2173 | AAAGUCGAAGUUCCAUCGCmUmU |
| 267 | 143 | CGAUGGAACUUCGACUUUGmUmU | 2174 | CAAAGUCGAAGUUCCAUCGmUmU |
| 268 | 144 | GAUGGAACUUCGACUUUGUmUmU | 2175 | ACAAAGUCGAAGUUCCAUCmUmU |
| 269 | 145 | AUGGAACUUCGACUUUGUCmUmU | 2176 | GACAAAGUCGAAGUUCCAUmUmU |
| 270 | 146 | UGGAACUUCGACUUUGUCAmUmU | 2177 | UGACAAAGUCGAAGUUCCAmUmU |
| 271 | 147 | GGAACUUCGACUUUGUCACmUmU | 2178 | GUGACAAAGUCGAAGUUCCmUmU |
| 272 | 148 | GAACUUCGACUUUGUCACCmUmU | 2179 | GGUGACAAAGUCGAAGUUCmUmU |
| 273 | 149 | AACUUCGACUUUGUCACCGmUmU | 2180 | CGGUGACAAAGUCGAAGUUmUmU |
| 274 | 150 | ACUUCGACUUUGUCACCGAmUmU | 2181 | UCGGUGACAAAGUCGAAGUmUmU |
| 275 | 151 | CUUCGACUUUGUCACCGAGmUmU | 2182 | CUCGGUGACAAAGUCGAAGmUmU |
| 276 | 152 | UUCGACUUUGUCACCGAGAmUmU | 2183 | UCUCGGUGACAAAGUCGAAmUmU |
| 277 | 153 | UCGACUUUGUCACCGAGACmUmU | 2184 | GUCUCGGUGACAAAGUCGAmUmU |
| 278 | 154 | CGACUUUGUCACCGAGACAmUmU | 2185 | UGUCUCGGUGACAAAGUCGmUmU |
| 279 | 155 | GACUUUGUCACCGAGACACmUmU | 2186 | GUGUCUCGGUGACAAAGUCmUmU |
| 280 | 156 | ACUUUGUCACCGAGACACCmUmU | 2187 | GGUGUCUCGGUGACAAAGUmUmU |
| 281 | 157 | CUUUGUCACCGAGACACCAmUmU | 2188 | UGGUGUCUCGGUGACAAAGmUmU |
| 282 | 158 | UUUGUCACCGAGACACCACmUmU | 2189 | GUGGUGUCUCGGUGACAAAmUmU |
| 283 | 159 | UUGUCACCGAGACACCACUmUmU | 2190 | AGUGGUGUCUCGGUGACAAmUmU |
| 284 | 160 | UGUCACCGAGACACCACUGmUmU | 2191 | CAGUGGUGUCUCGGUGACAmUmU |
| 285 | 161 | GUCACCGAGACACCACUGGmUmU | 2192 | CCAGUGGUGUCUCGGUGACmUmU |
| 286 | 162 | UCACCGAGACACCACUGGAmUmU | 2193 | UCCAGUGGUGUCUCGGUGAmUmU |
| 287 | 163 | CACCGAGACACCACUGGAGmUmU | 2194 | CUCCAGUGGUGUCUCGGUGmUmU |
| 288 | 164 | ACCGAGACACCACUGGAGGmUmU | 2195 | CCUCCAGUGGUGUCUCGGUmUmU |
| 289 | 165 | CCGAGACACCACUGGAGGGmUmU | 2196 | CCCUCCAGUGGUGUCUCGGmUmU |
| 290 | 166 | CGAGACACCACUGGAGGGUmUmU | 2197 | ACCCUCCAGUGGUGUCUCGmUmU |
| 291 | 167 | GAGACACCACUGGAGGGUGmUmU | 2198 | CACCCUCCAGUGGUGUCUCmUmU |
| 292 | 168 | AGACACCACUGGAGGGUGAmUmU | 2199 | UCACCCUCCAGUGGUGUCUmUmU |
| 293 | 169 | GACACCACUGGAGGGUGACmUmU | 2200 | GUCACCCUCCAGUGGUGUCmUmU |
| 294 | 170 | ACACCACUGGAGGGUGACUmUmU | 2201 | AGUCACCCUCCAGUGGUGUmUmU |
| 295 | 171 | CACCACUGGAGGGUGACUUmUmU | 2202 | AAGUCACCCUCCAGUGGUGmUmU |
| 296 | 172 | ACCACUGGAGGGUGACUUCmUmU | 2203 | GAAGUCACCCUCCAGUGGUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 297 | 173 | CCACUGGAGGGUGACUUCGmUmU | 2204 | CGAAGUCACCCUCCAGUGGmUmU |
| 298 | 174 | CACUGGAGGGUGACUUCGCmUmU | 2205 | GCGAAGUCACCCUCCAGUGmUmU |
| 299 | 175 | ACUGGAGGGUGACUUCGCCmUmU | 2206 | GGCGAAGUCACCCUCCAGUmUmU |
| 300 | 176 | CUGGAGGGUGACUUCGCCUmUmU | 2207 | AGGCGAAGUCACCCUCCAGmUmU |
| 301 | 177 | UGGAGGGUGACUUCGCCUGmUmU | 2208 | CAGGCGAAGUCACCCUCCAmUmU |
| 302 | 178 | GGAGGGUGACUUCGCCUGGmUmU | 2209 | CCAGGCGAAGUCACCCUCCmUmU |
| 303 | 179 | GAGGGUGACUUCGCCUGGGmUmU | 2210 | CCCAGGCGAAGUCACCCUCmUmU |
| 304 | 180 | AGGGUGACUUCGCCUGGGAmUmU | 2211 | UCCCAGGCGAAGUCACCCUmUmU |
| 305 | 181 | GGGUGACUUCGCCUGGGAGmUmU | 2212 | CUCCCAGGCGAAGUCACCCmUmU |
| 306 | 182 | GGUGACUUCGCCUGGGAGCmUmU | 2213 | GCUCCCAGGCGAAGUCACCmUmU |
| 307 | 183 | GUGACUUCGCCUGGGAGCGmUmU | 2214 | CGCUCCCAGGCGAAGUCACmUmU |
| 308 | 184 | UGACUUCGCCUGGGAGCGUmUmU | 2215 | ACGCUCCCAGGCGAAGUCAmUmU |
| 309 | 185 | GACUUCGCCUGGGAGCGUGmUmU | 2216 | CACGCUCCCAGGCGAAGUCmUmU |
| 310 | 186 | ACUUCGCCUGGGAGCGUGUmUmU | 2217 | ACACGCUCCCAGGCGAAGUmUmU |
| 311 | 187 | CUUCGCCUGGGAGCGUGUGmUmU | 2218 | CACACGCUCCCAGGCGAAGmUmU |
| 312 | 188 | UUCGCCUGGGAGCGUGUGCmUmU | 2219 | GCACACGCUCCCAGGCGAAmUmU |
| 313 | 189 | UCGCCUGGGAGCGUGUGCGmUmU | 2220 | CGCACACGCUCCCAGGCGAmUmU |
| 314 | 190 | CGCCUGGGAGCGUGUGCGGmUmU | 2221 | CCGCACACGCUCCCAGGCGmUmU |
| 315 | 191 | GCCUGGGAGCGUGUGCGGGmUmU | 2222 | CCCGCACACGCUCCCAGGCmUmU |
| 316 | 192 | CCUGGGAGCGUGUGCGGGGmUmU | 2223 | CCCCGCACACGCUCCCAGGmUmU |
| 317 | 193 | CUGGGAGCGUGUGCGGGGCmUmU | 2224 | GCCCCGCACACGCUCCCAGmUmU |
| 318 | 194 | UGGGAGCGUGUGCGGGGCCmUmU | 2225 | GGCCCCGCACACGCUCCCAmUmU |
| 319 | 195 | GGGAGCGUGUGCGGGGCCUmUmU | 2226 | AGGCCCCGCACACGCUCCCmUmU |
| 320 | 196 | GGAGCGUGUGCGGGGCCUUmUmU | 2227 | AAGGCCCCGCACACGCUCCmUmU |
| 321 | 197 | GAGCGUGUGCGGGGCCUUGmUmU | 2228 | CAAGGCCCCGCACACGCUCmUmU |
| 322 | 198 | AGCGUGUGCGGGGCCUUGGmUmU | 2229 | CCAAGGCCCCGCACACGCUmUmU |
| 323 | 199 | GCGUGUGCGGGGCCUUGGCmUmU | 2230 | GCCAAGGCCCCGCACACGCmUmU |
| 324 | 200 | CGUGUGCGGGGCCUUGGCCmUmU | 2231 | GGCCAAGGCCCCGCACACGmUmU |
| 325 | 201 | GUGUGCGGGGCCUUGGCCUmUmU | 2232 | AGGCCAAGGCCCCGCACACmUmU |
| 326 | 202 | UGUGCGGGGCCUUGGCCUGmUmU | 2233 | CAGGCCAAGGCCCCGCACAmUmU |
| 327 | 203 | GUGCGGGGCCUUGGCCUGCmUmU | 2234 | GCAGGCCAAGGCCCCGCACmUmU |
| 328 | 204 | UGCGGGGCCUUGGCCUGCCmUmU | 2235 | GGCAGGCCAAGGCCCCGCAmUmU |
| 329 | 205 | GCGGGGCCUUGGCCUGCCCmUmU | 2236 | GGGCAGGCCAAGGCCCCGCmUmU |
| 330 | 206 | CGGGGCCUUGGCCUGCCCAmUmU | 2237 | UGGGCAGGCCAAGGCCCCGmUmU |
| 331 | 207 | GGGGCCUUGGCCUGCCCAAmUmU | 2238 | UUGGGCAGGCCAAGGCCCCmUmU |
| 332 | 208 | GGGCCUUGGCCUGCCCAAGmUmU | 2239 | CUUGGGCAGGCCAAGGCCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 333 | 209 | GGCCUUGGCCUGCCCAAGCmUmU | 2240 | GCUUGGGCAGGCCAAGGCCmUmU |
| 334 | 210 | GCCUUGGCCUGCCCAAGCUmUmU | 2241 | AGCUUGGGCAGGCCAAGGCmUmU |
| 335 | 211 | CCUUGGCCUGCCCAAGCUCmUmU | 2242 | GAGCUUGGGCAGGCCAAGGmUmU |
| 336 | 212 | CUUGGCCUGCCCAAGCUCUmUmU | 2243 | AGAGCUUGGGCAGGCCAAGmUmU |
| 337 | 213 | UUGGCCUGCCCAAGCUCUAmUmU | 2244 | UAGAGCUUGGGCAGGCCAAmUmU |
| 338 | 214 | UGGCCUGCCCAAGCUCUACmUmU | 2245 | GUAGAGCUUGGGCAGGCCAmUmU |
| 339 | 215 | GGCCUGCCCAAGCUCUACCmUmU | 2246 | GGUAGAGCUUGGGCAGGCCmUmU |
| 340 | 216 | GCCUGCCCAAGCUCUACCUmUmU | 2247 | AGGUAGAGCUUGGGCAGGCmUmU |
| 341 | 217 | CCUGCCCAAGCUCUACCUUmUmU | 2248 | AAGGUAGAGCUUGGGCAGGmUmU |
| 342 | 218 | CUGCCCAAGCUCUACCUUCmUmU | 2249 | GAAGGUAGAGCUUGGGCAGmUmU |
| 343 | 219 | UGCCCAAGCUCUACCUUCCmUmU | 2250 | GGAAGGUAGAGCUUGGGCAmUmU |
| 344 | 220 | GCCCAAGCUCUACCUUCCCmUmU | 2251 | GGGAAGGUAGAGCUUGGGCmUmU |
| 345 | 221 | CCCAAGCUCUACCUUCCCAmUmU | 2252 | UGGGAAGGUAGAGCUUGGGmUmU |
| 346 | 222 | CCAAGCUCUACCUUCCCACmUmU | 2253 | GUGGGAAGGUAGAGCUUGGmUmU |
| 347 | 223 | CAAGCUCUACCUUCCCACGmUmU | 2254 | CGUGGGAAGGUAGAGCUUGmUmU |
| 348 | 224 | AAGCUCUACCUUCCCACGGmUmU | 2255 | CCGUGGGAAGGUAGAGCUUmUmU |
| 349 | 225 | AGCUCUACCUUCCCACGGGmUmU | 2256 | CCCGUGGGAAGGUAGAGCUmUmU |
| 350 | 226 | GCUCUACCUUCCCACGGGGmUmU | 2257 | CCCCGUGGGAAGGUAGAGCmUmU |
| 351 | 227 | CUCUACCUUCCCACGGGGCmUmU | 2258 | GCCCCGUGGGAAGGUAGAGmUmU |
| 352 | 228 | UCUACCUUCCCACGGGGCCmUmU | 2259 | GGCCCCGUGGGAAGGUAGAmUmU |
| 353 | 229 | CUACCUUCCCACGGGGCCCmUmU | 2260 | GGGCCCCGUGGGAAGGUAGmUmU |
| 354 | 230 | UACCUUCCCACGGGGCCCCmUmU | 2261 | GGGGCCCCGUGGGAAGGUAmUmU |
| 355 | 231 | ACCUUCCCACGGGGCCCCGmUmU | 2262 | CGGGGCCCCGUGGGAAGGUmUmU |
| 356 | 232 | CCUUCCCACGGGGCCCCGGmUmU | 2263 | CCGGGGCCCCGUGGGAAGGmUmU |
| 357 | 233 | CUUCCCACGGGGCCCCGGCmUmU | 2264 | GCCGGGGCCCCGUGGGAAGmUmU |
| 358 | 234 | UUCCCACGGGGCCCCGGCGmUmU | 2265 | CGCCGGGGCCCCGUGGGAAmUmU |
| 359 | 235 | UCCCACGGGGCCCCGGCGAmUmU | 2266 | UCGCCGGGGCCCCGUGGGAmUmU |
| 360 | 236 | CCCACGGGGCCCCGGCGAGmUmU | 2267 | CUCGCCGGGGCCCCGUGGGmUmU |
| 361 | 237 | CCACGGGGCCCCGGCGAGGmUmU | 2268 | CCUCGCCGGGGCCCCGUGGmUmU |
| 362 | 238 | CACGGGGCCCCGGCGAGGCmUmU | 2269 | GCCUCGCCGGGGCCCCGUGmUmU |
| 363 | 239 | ACGGGGCCCCGGCGAGGCCmUmU | 2270 | GGCCUCGCCGGGGCCCCGUmUmU |
| 364 | 240 | CGGGGCCCCGGCGAGGCCGmUmU | 2271 | CGGCCUCGCCGGGGCCCCGmUmU |
| 365 | 241 | GGGGCCCCGGCGAGGCCGGmUmU | 2272 | CCGGCCUCGCCGGGGCCCCmUmU |
| 366 | 242 | GGGCCCCGGCGAGGCCGGGmUmU | 2273 | CCCGGCCUCGCCGGGGCCCmUmU |
| 367 | 243 | GGCCCCGGCGAGGCCGGGAmUmU | 2274 | UCCCGGCCUCGCCGGGGCCmUmU |
| 368 | 244 | GCCCCGGCGAGGCCGGGAUmUmU | 2275 | AUCCCGGCCUCGCCGGGGCmUmU |
| 369 | 245 | CCCCGGCGAGGCCGGGAUGmUmU | 2276 | CAUCCCGGCCUCGCCGGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 370 | 246 | CCCGGCGAGGCCGGGAUGAmUmU | 2277 | UCAUCCCGGCCUCGCCGGGmUmU |
| 371 | 247 | CCGGCGAGGCCGGGAUGAGmUmU | 2278 | CUCAUCCCGGCCUCGCCGGmUmU |
| 372 | 248 | CGGCGAGGCCGGGAUGAGUmUmU | 2279 | ACUCAUCCCGGCCUCGCCGmUmU |
| 373 | 249 | GGCGAGGCCGGGAUGAGUUmUmU | 2280 | AACUCAUCCCGGCCUCGCCmUmU |
| 374 | 250 | GCGAGGCCGGGAUGAGUUGmUmU | 2281 | CAACUCAUCCCGGCCUCGCmUmU |
| 375 | 251 | CGAGGCCGGGAUGAGUUGGmUmU | 2282 | CCAACUCAUCCCGGCCUCGmUmU |
| 376 | 252 | GAGGCCGGGAUGAGUUGGGmUmU | 2283 | CCCAACUCAUCCCGGCCUCmUmU |
| 377 | 253 | AGGCCGGGAUGAGUUGGGAmUmU | 2284 | UCCCAACUCAUCCCGGCCUmUmU |
| 378 | 254 | GGCCGGGAUGAGUUGGGAGmUmU | 2285 | CUCCCAACUCAUCCCGGCCmUmU |
| 379 | 255 | GCCGGGAUGAGUUGGGAGGmUmU | 2286 | CCUCCCAACUCAUCCCGGCmUmU |
| 380 | 256 | CCGGGAUGAGUUGGGAGGAmUmU | 2287 | UCCUCCCAACUCAUCCCGGmUmU |
| 381 | 257 | CGGGAUGAGUUGGGAGGAGmUmU | 2288 | CUCCUCCCAACUCAUCCCGmUmU |
| 382 | 258 | GGGAUGAGUUGGGAGGAGGmUmU | 2289 | CCUCCUCCCAACUCAUCCCmUmU |
| 383 | 259 | GGAUGAGUUGGGAGGAGGCmUmU | 2290 | GCCUCCUCCCAACUCAUCCmUmU |
| 384 | 260 | GAUGAGUUGGGAGGAGGCAmUmU | 2291 | UGCCUCCUCCCAACUCAUCmUmU |
| 385 | 261 | AUGAGUUGGGAGGAGGCAGmUmU | 2292 | CUGCCUCCUCCCAACUCAUmUmU |
| 386 | 262 | UGAGUUGGGAGGAGGCAGGmUmU | 2293 | CCUGCCUCCUCCCAACUCAmUmU |
| 387 | 263 | GAGUUGGGAGGAGGCAGGCmUmU | 2294 | GCCUGCCUCCUCCCAACUCmUmU |
| 388 | 264 | AGUUGGGAGGAGGCAGGCGmUmU | 2295 | CGCCUGCCUCCUCCCAACUmUmU |
| 389 | 265 | GUUGGGAGGAGGCAGGCGGmUmU | 2296 | CCGCCUGCCUCCUCCCAACmUmU |
| 390 | 266 | UUGGGAGGAGGCAGGCGGCmUmU | 2297 | GCCGCCUGCCUCCUCCCAAmUmU |
| 391 | 267 | UGGGAGGAGGCAGGCGGCCmUmU | 2298 | GGCCGCCUGCCUCCUCCCAmUmU |
| 392 | 268 | GGGAGGAGGCAGGCGGCCUmUmU | 2299 | AGGCCGCCUGCCUCCUCCCmUmU |
| 393 | 269 | GGAGGAGGCAGGCGGCCUGmUmU | 2300 | CAGGCCGCCUGCCUCCUCCmUmU |
| 394 | 270 | GAGGAGGCAGGCGGCCUGGmUmU | 2301 | CCAGGCCGCCUGCCUCCUCmUmU |
| 395 | 271 | AGGAGGCAGGCGGCCUGGCmUmU | 2302 | GCCAGGCCGCCUGCCUCCUmUmU |
| 396 | 272 | GGAGGCAGGCGGCCUGGCAmUmU | 2303 | UGCCAGGCCGCCUGCCUCCmUmU |
| 397 | 273 | GAGGCAGGCGGCCUGGCACmUmU | 2304 | GUGCCAGGCCGCCUGCCUCmUmU |
| 398 | 274 | AGGCAGGCGGCCUGGCACCmUmU | 2305 | GGUGCCAGGCCGCCUGCCUmUmU |
| 399 | 275 | GGCAGGCGGCCUGGCACCUmUmU | 2306 | AGGUGCCAGGCCGCCUGCCmUmU |
| 400 | 276 | GCAGGCGGCCUGGCACCUCmUmU | 2307 | GAGGUGCCAGGCCGCCUGCmUmU |
| 401 | 277 | CAGGCGGCCUGGCACCUCAmUmU | 2308 | UGAGGUGCCAGGCCGCCUGmUmU |
| 402 | 278 | AGGCGGCCUGGCACCUCACmUmU | 2309 | GUGAGGUGCCAGGCCGCCUmUmU |
| 403 | 279 | GGCGGCCUGGCACCUCACCmUmU | 2310 | GGUGAGGUGCCAGGCCGCCmUmU |
| 404 | 280 | GCGGCCUGGCACCUCACCUmUmU | 2311 | AGGUGAGGUGCCAGGCCGCmUmU |
| 405 | 281 | CGGCCUGGCACCUCACCUGmUmU | 2312 | CAGGUGAGGUGCCAGGCCGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 406 | 282 | GGCCUGGCACCUCACCUGCmUmU | 2313 | GCAGGUGAGGUGCCAGGCmUmU |
| 407 | 283 | GCCUGGCACCUCACCUGCUmUmU | 2314 | AGCAGGUGAGGUGCCAGGCmUmU |
| 408 | 284 | CCUGGCACCUCACCUGCUCmUmU | 2315 | GAGCAGGUGAGGUGCCAGGmUmU |
| 409 | 285 | CUGGCACCUCACCUGCUCUmUmU | 2316 | AGAGCAGGUGAGGUGCCAGmUmU |
| 410 | 286 | UGGCACCUCACCUGCUCUGmUmU | 2317 | CAGAGCAGGUGAGGUGCCAmUmU |
| 411 | 287 | GGCACCUCACCUGCUCUGCmUmU | 2318 | GCAGAGCAGGUGAGGUGCCmUmU |
| 412 | 288 | GCACCUCACCUGCUCUGCUmUmU | 2319 | AGCAGAGCAGGUGAGGUGCmUmU |
| 413 | 289 | CACCUCACCUGCUCUGCUGmUmU | 2320 | CAGCAGAGCAGGUGAGGUGmUmU |
| 414 | 290 | ACCUCACCUGCUCUGCUGCmUmU | 2321 | GCAGCAGAGCAGGUGAGGUmUmU |
| 415 | 291 | CCUCACCUGCUCUGCUGCAmUmU | 2322 | UGCAGCAGAGCAGGUGAGGmUmU |
| 416 | 292 | CUCACCUGCUCUGCUGCAGmUmU | 2323 | CUGCAGCAGAGCAGGUGAGmUmU |
| 417 | 293 | UCACCUGCUCUGCUGCAGGmUmU | 2324 | CCUGCAGCAGAGCAGGUGAmUmU |
| 418 | 294 | CACCUGCUCUGCUGCAGGGmUmU | 2325 | CCCUGCAGCAGAGCAGGUGmUmU |
| 419 | 295 | ACCUGCUCUGCUGCAGGGGmUmU | 2326 | CCCCUGCAGCAGAGCAGGUmUmU |
| 420 | 296 | CCUGCUCUGCUGCAGGGGAmUmU | 2327 | UCCCCUGCAGCAGAGCAGGmUmU |
| 421 | 297 | CUGCUCUGCUGCAGGGGACmUmU | 2328 | GUCCCCUGCAGCAGAGCAGmUmU |
| 422 | 298 | UGCUCUGCUGCAGGGGACAmUmU | 2329 | UGUCCCCUGCAGCAGAGCAmUmU |
| 423 | 299 | GCUCUGCUGCAGGGGACAGmUmU | 2330 | CUGUCCCCUGCAGCAGAGCmUmU |
| 424 | 300 | CUCUGCUGCAGGGGACAGCmUmU | 2331 | GCUGUCCCCUGCAGCAGAGmUmU |
| 425 | 301 | UCUGCUGCAGGGGACAGCAmUmU | 2332 | UGCUGUCCCCUGCAGCAGAmUmU |
| 426 | 302 | CUGCUGCAGGGGACAGCAGmUmU | 2333 | CUGCUGUCCCCUGCAGCAGmUmU |
| 427 | 303 | UGCUGCAGGGGACAGCAGAmUmU | 2334 | UCUGCUGUCCCCUGCAGCAmUmU |
| 428 | 304 | GCUGCAGGGGACAGCAGAGmUmU | 2335 | CUCUGCUGUCCCCUGCAGCmUmU |
| 429 | 305 | CUGCAGGGGACAGCAGAGGmUmU | 2336 | CCUCUGCUGUCCCCUGCAGmUmU |
| 430 | 306 | UGCAGGGGACAGCAGAGGAmUmU | 2337 | UCCUCUGCUGUCCCCUGCAmUmU |
| 431 | 307 | GCAGGGGACAGCAGAGGAAmUmU | 2338 | UUCCUCUGCUGUCCCCUGCmUmU |
| 432 | 308 | CAGGGGACAGCAGAGGAAGmUmU | 2339 | CUUCCUCUGCUGUCCCCUGmUmU |
| 433 | 309 | AGGGGACAGCAGAGGAAGAmUmU | 2340 | UCUUCCUCUGCUGUCCCCUmUmU |
| 434 | 310 | GGGGACAGCAGAGGAAGACmUmU | 2341 | GUCUUCCUCUGCUGUCCCCmUmU |
| 435 | 311 | GGGACAGCAGAGGAAGACCmUmU | 2342 | GGUCUUCCUCUGCUGUCCCmUmU |
| 436 | 312 | GGACAGCAGAGGAAGACCAmUmU | 2343 | UGGUCUUCCUCUGCUGUCCmUmU |
| 437 | 313 | GACAGCAGAGGAAGACCAUmUmU | 2344 | AUGGUCUUCCUCUGCUGUCmUmU |
| 438 | 314 | ACAGCAGAGGAAGACCAUGmUmU | 2345 | CAUGGUCUUCCUCUGCUGUmUmU |
| 439 | 315 | CAGCAGAGGAAGACCAUGUmUmU | 2346 | ACAUGGUCUUCCUCUGCUGmUmU |
| 440 | 316 | AGCAGAGGAAGACCAUGUGmUmU | 2347 | CACAUGGUCUUCCUCUGCUmUmU |
| 441 | 317 | GCAGAGGAAGACCAUGUGGmUmU | 2348 | CCACAUGGUCUUCCUCUGCmUmU |
| 442 | 318 | CAGAGGAAGACCAUGUGGAmUmU | 2349 | UCCACAUGGUCUUCCUCUGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 443 | 319 | AGAGGAAGACCAUGUGGACmUmU | 2350 | GUCCACAUGGUCUUCCUCUmUmU |
| 444 | 320 | GAGGAAGACCAUGUGGACCmUmU | 2351 | GGUCCACAUGGUCUUCCUCmUmU |
| 445 | 321 | AGGAAGACCAUGUGGACCUmUmU | 2352 | AGGUCCACAUGGUCUUCCUmUmU |
| 446 | 322 | GGAAGACCAUGUGGACCUGmUmU | 2353 | CAGGUCCACAUGGUCUUCCmUmU |
| 447 | 323 | GAAGACCAUGUGGACCUGUmUmU | 2354 | ACAGGUCCACAUGGUCUUCmUmU |
| 448 | 324 | AAGACCAUGUGGACCUGUCmUmU | 2355 | GACAGGUCCACAUGGUCUUmUmU |
| 449 | 325 | AGACCAUGUGGACCUGUCAmUmU | 2356 | UGACAGGUCCACAUGGUCUmUmU |
| 450 | 326 | GACCAUGUGGACCUGUCACmUmU | 2357 | GUGACAGGUCCACAUGGUCmUmU |
| 451 | 327 | ACCAUGUGGACCUGUCACUmUmU | 2358 | AGUGACAGGUCCACAUGGUmUmU |
| 452 | 328 | CCAUGUGGACCUGUCACUGmUmU | 2359 | CAGUGACAGGUCCACAUGGmUmU |
| 453 | 329 | CAUGUGGACCUGUCACUGUmUmU | 2360 | ACAGUGACAGGUCCACAUGmUmU |
| 454 | 330 | AUGUGGACCUGUCACUGUCmUmU | 2361 | GACAGUGACAGGUCCACAUmUmU |
| 455 | 331 | UGUGGACCUGUCACUGUCUmUmU | 2362 | AGACAGUGACAGGUCCACAmUmU |
| 456 | 332 | GUGGACCUGUCACUGUCUUmUmU | 2363 | AAGACAGUGACAGGUCCACmUmU |
| 457 | 333 | UGGACCUGUCACUGUCUUGmUmU | 2364 | CAAGACAGUGACAGGUCCAmUmU |
| 458 | 334 | GGACCUGUCACUGUCUUGUmUmU | 2365 | ACAAGACAGUGACAGGUCCmUmU |
| 459 | 335 | GACCUGUCACUGUCUUGUAmUmU | 2366 | UACAAGACAGUGACAGGUCmUmU |
| 460 | 336 | ACCUGUCACUGUCUUGUACmUmU | 2367 | GUACAAGACAGUGACAGGUmUmU |
| 461 | 337 | CCUGUCACUGUCUUGUACCmUmU | 2368 | GGUACAAGACAGUGACAGGmUmU |
| 462 | 338 | CUGUCACUGUCUUGUACCCmUmU | 2369 | GGGUACAAGACAGUGACAGmUmU |
| 463 | 339 | UGUCACUGUCUUGUACCCUmUmU | 2370 | AGGGUACAAGACAGUGACAmUmU |
| 464 | 340 | GUCACUGUCUUGUACCCUUmUmU | 2371 | AAGGGUACAAGACAGUGACmUmU |
| 465 | 341 | UCACUGUCUUGUACCCUUGmUmU | 2372 | CAAGGGUACAAGACAGUGAmUmU |
| 466 | 342 | CACUGUCUUGUACCCUUGUmUmU | 2373 | ACAAGGGUACAAGACAGUGmUmU |
| 467 | 343 | ACUGUCUUGUACCCUUGUGmUmU | 2374 | CACAAGGGUACAAGACAGUmUmU |
| 468 | 344 | CUGUCUUGUACCCUUGUGCmUmU | 2375 | GCACAAGGGUACAAGACAGmUmU |
| 469 | 345 | UGUCUUGUACCCUUGUGCCmUmU | 2376 | GGCACAAGGGUACAAGACAmUmU |
| 470 | 346 | GUCUUGUACCCUUGUGCCUmUmU | 2377 | AGGCACAAGGGUACAAGACmUmU |
| 471 | 347 | UCUUGUACCCUUGUGCCUCmUmU | 2378 | GAGGCACAAGGGUACAAGAmUmU |
| 472 | 348 | CUUGUACCCUUGUGCCUCGmUmU | 2379 | CGAGGCACAAGGGUACAAGmUmU |
| 473 | 349 | UUGUACCCUUGUGCCUCGCmUmU | 2380 | GCGAGGCACAAGGGUACAAmUmU |
| 474 | 350 | UGUACCCUUGUGCCUCGCUmUmU | 2381 | AGCGAGGCACAAGGGUACAmUmU |
| 475 | 351 | GUACCCUUGUGCCUCGCUCmUmU | 2382 | GAGCGAGGCACAAGGGUACmUmU |
| 476 | 352 | UACCCUUGUGCCUCGCUCAmUmU | 2383 | UGAGCGAGGCACAAGGGUAmUmU |
| 477 | 353 | ACCCUUGUGCCUCGCUCAGmUmU | 2384 | CUGAGCGAGGCACAAGGGUmUmU |
| 478 | 354 | CCCUUGUGCCUCGCUCAGGmUmU | 2385 | CCUGAGCGAGGCACAAGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 479 | 355 | CCUUGUGCCUCGCUCAGGGGmUmU | 2386 | CCCUGAGCGAGGCACAAGGmUmU |
| 480 | 356 | CUUGUGCCUCGCUCAGGGGmUmU | 2387 | CCCCUGAGCGAGGCACAAGmUmU |
| 481 | 357 | UUGUGCCUCGCUCAGGGGAmUmU | 2388 | UCCCCUGAGCGAGGCACAAmUmU |
| 482 | 358 | UGUGCCUCGCUCAGGGGAGmUmU | 2389 | CUCCCCUGAGCGAGGCACAmUmU |
| 483 | 359 | GUGCCUCGCUCAGGGGAGCmUmU | 2390 | GCUCCCCUGAGCGAGGCACmUmU |
| 484 | 360 | UGCCUCGCUCAGGGGAGCAmUmU | 2391 | UGCUCCCCUGAGCGAGGCAmUmU |
| 485 | 361 | GCCUCGCUCAGGGGAGCAGmUmU | 2392 | CUGCUCCCCUGAGCGAGGCmUmU |
| 486 | 362 | CCUCGCUCAGGGGAGCAGGmUmU | 2393 | CCUGCUCCCCUGAGCGAGGmUmU |
| 487 | 363 | CUCGCUCAGGGGAGCAGGCmUmU | 2394 | GCCUGCUCCCCUGAGCGAGmUmU |
| 488 | 364 | UCGCUCAGGGGAGCAGGCUmUmU | 2395 | AGCCUGCUCCCCUGAGCGAmUmU |
| 489 | 365 | CGCUCAGGGGAGCAGGCUGmUmU | 2396 | CAGCCUGCUCCCCUGAGCGmUmU |
| 490 | 366 | GCUCAGGGGAGCAGGCUGAmUmU | 2397 | UCAGCCUGCUCCCCUGAGCmUmU |
| 491 | 367 | CUCAGGGGAGCAGGCUGAAmUmU | 2398 | UUCAGCCUGCUCCCCUGAGmUmU |
| 492 | 368 | UCAGGGGAGCAGGCUGAAGmUmU | 2399 | CUUCAGCCUGCUCCCCUGAmUmU |
| 493 | 369 | CAGGGGAGCAGGCUGAAGGmUmU | 2400 | CCUUCAGCCUGCUCCCCUGmUmU |
| 494 | 370 | AGGGGAGCAGGCUGAAGGGmUmU | 2401 | CCCUUCAGCCUGCUCCCCUmUmU |
| 495 | 371 | GGGGAGCAGGCUGAAGGGUmUmU | 2402 | ACCCUUCAGCCUGCUCCCCmUmU |
| 496 | 372 | GGGAGCAGGCUGAAGGGUCmUmU | 2403 | GACCCUUCAGCCUGCUCCCmUmU |
| 497 | 373 | GGAGCAGGCUGAAGGGUCCmUmU | 2404 | GGACCCUUCAGCCUGCUCCmUmU |
| 498 | 374 | GAGCAGGCUGAAGGGUCCCmUmU | 2405 | GGGACCCUUCAGCCUGCUCmUmU |
| 499 | 375 | AGCAGGCUGAAGGGUCCCCmUmU | 2406 | GGGGACCCUUCAGCCUGCUmUmU |
| 500 | 376 | GCAGGCUGAAGGGUCCCCAmUmU | 2407 | UGGGGACCCUUCAGCCUGCmUmU |
| 501 | 377 | CAGGCUGAAGGGUCCCCAGmUmU | 2408 | CUGGGGACCCUUCAGCCUGmUmU |
| 502 | 378 | AGGCUGAAGGGUCCCCAGGmUmU | 2409 | CCUGGGGACCCUUCAGCCUmUmU |
| 503 | 379 | GGCUGAAGGGUCCCCAGGUmUmU | 2410 | ACCUGGGGACCCUUCAGCCmUmU |
| 504 | 380 | GCUGAAGGGUCCCCAGGUGmUmU | 2411 | CACCUGGGGACCCUUCAGCmUmU |
| 505 | 381 | CUGAAGGGUCCCCAGGUGGmUmU | 2412 | CCACCUGGGGACCCUUCAGmUmU |
| 506 | 382 | UGAAGGGUCCCCAGGUGGAmUmU | 2413 | UCCACCUGGGGACCCUUCAmUmU |
| 507 | 383 | GAAGGGUCCCCAGGUGGACmUmU | 2414 | GUCCACCUGGGGACCCUUCmUmU |
| 508 | 384 | AAGGGUCCCCAGGUGGACCmUmU | 2415 | GGUCCACCUGGGGACCCUUmUmU |
| 509 | 385 | AGGGUCCCCAGGUGGACCUmUmU | 2416 | AGGUCCACCUGGGGACCCUmUmU |
| 510 | 386 | GGGUCCCCAGGUGGACCUGmUmU | 2417 | CAGGUCCACCUGGGGACCCmUmU |
| 511 | 387 | GGUCCCCAGGUGGACCUGGmUmU | 2418 | CCAGGUCCACCUGGGGACCmUmU |
| 512 | 388 | GUCCCCAGGUGGACCUGGAmUmU | 2419 | UCCAGGUCCACCUGGGGACmUmU |
| 513 | 389 | UCCCCAGGUGGACCUGGAGmUmU | 2420 | CUCCAGGUCCACCUGGGGAmUmU |
| 514 | 390 | CCCCAGGUGGACCUGGAGAmUmU | 2421 | UCUCCAGGUCCACCUGGGGmUmU |
| 515 | 391 | CCCAGGUGGACCUGGAGACmUmU | 2422 | GUCUCCAGGUCCACCUGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 516 | 392 | CCAGGUGGACCUGGAGACUmUmU | 2423 | AGUCUCCAGGUCCACCUGGmUmU |
| 517 | 393 | CAGGUGGACCUGGAGACUCmUmU | 2424 | GAGUCUCCAGGUCCACCUGmUmU |
| 518 | 394 | AGGUGGACCUGGAGACUCUmUmU | 2425 | AGAGUCUCCAGGUCCACCUmUmU |
| 519 | 395 | GGUGGACCUGGAGACUCUCmUmU | 2426 | GAGAGUCUCCAGGUCCACCmUmU |
| 520 | 396 | GUGGACCUGGAGACUCUCAmUmU | 2427 | UGAGAGUCUCCAGGUCCACmUmU |
| 521 | 397 | UGGACCUGGAGACUCUCAGmUmU | 2428 | CUGAGAGUCUCCAGGUCCAmUmU |
| 522 | 398 | GGACCUGGAGACUCUCAGGmUmU | 2429 | CCUGAGAGUCUCCAGGUCCmUmU |
| 523 | 399 | GACCUGGAGACUCUCAGGGmUmU | 2430 | CCCUGAGAGUCUCCAGGUCmUmU |
| 524 | 400 | ACCUGGAGACUCUCAGGGUmUmU | 2431 | ACCCUGAGAGUCUCCAGGUmUmU |
| 525 | 401 | CCUGGAGACUCUCAGGGUCmUmU | 2432 | GACCCUGAGAGUCUCCAGGmUmU |
| 526 | 402 | CUGGAGACUCUCAGGGUCGmUmU | 2433 | CGACCCUGAGAGUCUCCAGmUmU |
| 527 | 403 | UGGAGACUCUCAGGGUCGAmUmU | 2434 | UCGACCCUGAGAGUCUCCAmUmU |
| 528 | 404 | GGAGACUCUCAGGGUCGAAmUmU | 2435 | UUCGACCCUGAGAGUCUCCmUmU |
| 529 | 405 | GAGACUCUCAGGGUCGAAAmUmU | 2436 | UUUCGACCCUGAGAGUCUCmUmU |
| 530 | 406 | AGACUCUCAGGGUCGAAAAmUmU | 2437 | UUUUCGACCCUGAGAGUCUmUmU |
| 531 | 407 | GACUCUCAGGGUCGAAAACmUmU | 2438 | GUUUUCGACCCUGAGAGUCmUmU |
| 532 | 408 | ACUCUCAGGGUCGAAAACGmUmU | 2439 | CGUUUUCGACCCUGAGAGUmUmU |
| 533 | 409 | CUCUCAGGGUCGAAAACGGmUmU | 2440 | CCGUUUUCGACCCUGAGAGmUmU |
| 534 | 410 | UCUCAGGGUCGAAAACGGCmUmU | 2441 | GCCGUUUUCGACCCUGAGAmUmU |
| 535 | 411 | CUCAGGGUCGAAAACGGCGmUmU | 2442 | CGCCGUUUUCGACCCUGAGmUmU |
| 536 | 412 | UCAGGGUCGAAAACGGCGGmUmU | 2443 | CCGCCGUUUUCGACCCUGAmUmU |
| 537 | 413 | CAGGGUCGAAAACGGCGGCmUmU | 2444 | GCCGCCGUUUUCGACCCUGmUmU |
| 538 | 414 | AGGGUCGAAAACGGCGGCAmUmU | 2445 | UGCCGCCGUUUUCGACCCUmUmU |
| 539 | 415 | GGGUCGAAAACGGCGGCAGmUmU | 2446 | CUGCCGCCGUUUUCGACCCmUmU |
| 540 | 416 | GGUCGAAAACGGCGGCAGAmUmU | 2447 | UCUGCCGCCGUUUUCGACCmUmU |
| 541 | 417 | GUCGAAAACGGCGGCAGACmUmU | 2448 | GUCUGCCGCCGUUUUCGACmUmU |
| 542 | 418 | UCGAAAACGGCGGCAGACCmUmU | 2449 | GGUCUGCCGCCGUUUUCGAmUmU |
| 543 | 419 | CGAAAACGGCGGCAGACCAmUmU | 2450 | UGGUCUGCCGCCGUUUUCGmUmU |
| 544 | 420 | GAAAACGGCGGCAGACCAGmUmU | 2451 | CUGGUCUGCCGCCGUUUUCmUmU |
| 545 | 421 | AAAACGGCGGCAGACCAGCmUmU | 2452 | GCUGGUCUGCCGCCGUUUUmUmU |
| 546 | 422 | AAACGGCGGCAGACCAGCAmUmU | 2453 | UGCUGGUCUGCCGCCGUUUmUmU |
| 547 | 423 | AACGGCGGCAGACCAGCAUmUmU | 2454 | AUGCUGGUCUGCCGCCGUUmUmU |
| 548 | 424 | ACGGCGGCAGACCAGCAUGmUmU | 2455 | CAUGCUGGUCUGCCGCCGUmUmU |
| 549 | 425 | CGGCGGCAGACCAGCAUGAmUmU | 2456 | UCAUGCUGGUCUGCCGCCGmUmU |
| 550 | 426 | GGCGGCAGACCAGCAUGACmUmU | 2457 | GUCAUGCUGGUCUGCCGCCmUmU |
| 551 | 427 | GCGGCAGACCAGCAUGACAmUmU | 2458 | UGUCAUGCUGGUCUGCCGCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 552 | 428 | CGGCAGACCAGCAUGACAGmUmU | 2459 | CUGUCAUGCUGGUCUGCCGmUmU |
| 553 | 429 | GGCAGACCAGCAUGACAGAmUmU | 2460 | UCUGUCAUGCUGGUCUGCCmUmU |
| 554 | 430 | GCAGACCAGCAUGACAGAUmUmU | 2461 | AUCUGUCAUGCUGGUCUGCmUmU |
| 555 | 431 | CAGACCAGCAUGACAGAUUmUmU | 2462 | AAUCUGUCAUGCUGGUCUGmUmU |
| 556 | 432 | AGACCAGCAUGACAGAUUUmUmU | 2463 | AAAUCUGUCAUGCUGGUCUmUmU |
| 557 | 433 | GACCAGCAUGACAGAUUUCmUmU | 2464 | GAAAUCUGUCAUGCUGGUCmUmU |
| 558 | 434 | ACCAGCAUGACAGAUUUCUmUmU | 2465 | AGAAAUCUGUCAUGCUGGUmUmU |
| 559 | 435 | CCAGCAUGACAGAUUUCUAmUmU | 2466 | UAGAAAUCUGUCAUGCUGGmUmU |
| 560 | 436 | CAGCAUGACAGAUUUCUACmUmU | 2467 | GUAGAAAUCUGUCAUGCUGmUmU |
| 561 | 437 | AGCAUGACAGAUUUCUACCmUmU | 2468 | GGUAGAAAUCUGUCAUGCUmUmU |
| 562 | 438 | GCAUGACAGAUUUCUACCAmUmU | 2469 | UGGUAGAAAUCUGUCAUGCmUmU |
| 563 | 439 | CAUGACAGAUUUCUACCACmUmU | 2470 | GUGGUAGAAAUCUGUCAUGmUmU |
| 564 | 440 | AUGACAGAUUUCUACCACUmUmU | 2471 | AGUGGUAGAAAUCUGUCAUmUmU |
| 565 | 441 | UGACAGAUUUCUACCACUCmUmU | 2472 | GAGUGGUAGAAAUCUGUCAmUmU |
| 566 | 442 | GACAGAUUUCUACCACUCCmUmU | 2473 | GGAGUGGUAGAAAUCUGUCmUmU |
| 567 | 443 | ACAGAUUUCUACCACUCCAmUmU | 2474 | UGGAGUGGUAGAAAUCUGUmUmU |
| 568 | 444 | CAGAUUUCUACCACUCCAAmUmU | 2475 | UUGGAGUGGUAGAAAUCUGmUmU |
| 569 | 445 | AGAUUUCUACCACUCCAAAmUmU | 2476 | UUUGGAGUGGUAGAAAUCUmUmU |
| 570 | 446 | GAUUUCUACCACUCCAAACmUmU | 2477 | GUUUGGAGUGGUAGAAAUCmUmU |
| 571 | 447 | AUUUCUACCACUCCAAACGmUmU | 2478 | CGUUUGGAGUGGUAGAAAUmUmU |
| 572 | 448 | UUUCUACCACUCCAAACGCmUmU | 2479 | GCGUUUGGAGUGGUAGAAAmUmU |
| 573 | 449 | UUCUACCACUCCAAACGCCmUmU | 2480 | GGCGUUUGGAGUGGUAGAAmUmU |
| 574 | 450 | UCUACCACUCCAAACGCCGmUmU | 2481 | CGGCGUUUGGAGUGGUAGAmUmU |
| 575 | 451 | CUACCACUCCAAACGCCGGmUmU | 2482 | CCGGCGUUUGGAGUGGUAGmUmU |
| 576 | 452 | UACCACUCCAAACGCCGGCmUmU | 2483 | GCCGGCGUUUGGAGUGGUAmUmU |
| 577 | 453 | ACCACUCCAAACGCCGGCUmUmU | 2484 | AGCCGGCGUUUGGAGUGGUmUmU |
| 578 | 454 | CCACUCCAAACGCCGGCUGmUmU | 2485 | CAGCCGGCGUUUGGAGUGGmUmU |
| 579 | 455 | CACUCCAAACGCCGGCUGAmUmU | 2486 | UCAGCCGGCGUUUGGAGUGmUmU |
| 580 | 456 | ACUCCAAACGCCGGCUGAUmUmU | 2487 | AUCAGCCGGCGUUUGGAGUmUmU |
| 581 | 457 | CUCCAAACGCCGGCUGAUCmUmU | 2488 | GAUCAGCCGGCGUUUGGAGmUmU |
| 582 | 458 | UCCAAACGCCGGCUGAUCUmUmU | 2489 | AGAUCAGCCGGCGUUUGGAmUmU |
| 583 | 459 | CCAAACGCCGGCUGAUCUUmUmU | 2490 | AAGAUCAGCCGGCGUUUGGmUmU |
| 584 | 460 | CAAACGCCGGCUGAUCUUCmUmU | 2491 | GAAGAUCAGCCGGCGUUUGmUmU |
| 585 | 461 | AAACGCCGGCUGAUCUUCUmUmU | 2492 | AGAAGAUCAGCCGGCGUUUmUmU |
| 586 | 462 | AACGCCGGCUGAUCUUCUCmUmU | 2493 | GAGAAGAUCAGCCGGCGUUmUmU |
| 587 | 463 | ACGCCGGCUGAUCUUCUCCmUmU | 2494 | GGAGAAGAUCAGCCGGCGUmUmU |
| 588 | 464 | CGCCGGCUGAUCUUCUCCAmUmU | 2495 | UGGAGAAGAUCAGCCGGCGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 589 | 465 | GCCGGCUGAUCUUCUCCAAmUmU | 2496 | UUGGAGAAGAUCAGCCGGCmUmU |
| 590 | 466 | CCGGCUGAUCUUCUCCAAGmUmU | 2497 | CUUGGAGAAGAUCAGCCGGmUmU |
| 591 | 467 | CGGCUGAUCUUCUCCAAGAmUmU | 2498 | UCUUGGAGAAGAUCAGCCGmUmU |
| 592 | 468 | GGCUGAUCUUCUCCAAGAGmUmU | 2499 | CUCUUGGAGAAGAUCAGCCmUmU |
| 593 | 469 | GCUGAUCUUCUCCAAGAGGmUmU | 2500 | CCUCUUGGAGAAGAUCAGCmUmU |
| 594 | 470 | CUGAUCUUCUCCAAGAGGAmUmU | 2501 | UCCUCUUGGAGAAGAUCAGmUmU |
| 595 | 471 | UGAUCUUCUCCAAGAGGAAmUmU | 2502 | UUCCUCUUGGAGAAGAUCAmUmU |
| 596 | 472 | GAUCUUCUCCAAGAGGAAGmUmU | 2503 | CUUCCUCUUGGAGAAGAUCmUmU |
| 597 | 473 | AUCUUCUCCAAGAGGAAGCmUmU | 2504 | GCUUCCUCUUGGAGAAGAUmUmU |
| 598 | 474 | UCUUCUCCAAGAGGAAGCCmUmU | 2505 | GGCUUCCUCUUGGAGAAGAmUmU |
| 599 | 475 | CUUCUCCAAGAGGAAGCCCmUmU | 2506 | GGGCUUCCUCUUGGAGAAGmUmU |
| 600 | 476 | UUCUCCAAGAGGAAGCCCUmUmU | 2507 | AGGGCUUCCUCUUGGAGAAmUmU |
| 601 | 477 | UCUCCAAGAGGAAGCCCUAmUmU | 2508 | UAGGGCUUCCUCUUGGAGAmUmU |
| 602 | 478 | CUCCAAGAGGAAGCCCUAAmUmU | 2509 | UUAGGGCUUCCUCUUGGAGmUmU |
| 603 | 479 | UCCAAGAGGAAGCCCUAAUmUmU | 2510 | AUUAGGGCUUCCUCUUGGAmUmU |
| 604 | 480 | CCAAGAGGAAGCCCUAAUCmUmU | 2511 | GAUUAGGGCUUCCUCUUGGmUmU |
| 605 | 481 | CAAGAGGAAGCCCUAAUCCmUmU | 2512 | GGAUUAGGGCUUCCUCUUGmUmU |
| 606 | 482 | AAGAGGAAGCCCUAAUCCGmUmU | 2513 | CGGAUUAGGGCUUCCUCUUmUmU |
| 607 | 483 | AGAGGAAGCCCUAAUCCGCmUmU | 2514 | GCGGAUUAGGGCUUCCUCUmUmU |
| 608 | 484 | GAGGAAGCCCUAAUCCGCCmUmU | 2515 | GGCGGAUUAGGGCUUCCUCmUmU |
| 609 | 485 | AGGAAGCCCUAAUCCGCCCmUmU | 2516 | GGGCGGAUUAGGGCUUCCUmUmU |
| 610 | 486 | GGAAGCCCUAAUCCGCCCAmUmU | 2517 | UGGGCGGAUUAGGGCUUCCmUmU |
| 611 | 487 | GAAGCCCUAAUCCGCCCACmUmU | 2518 | GUGGGCGGAUUAGGGCUUCmUmU |
| 612 | 488 | AAGCCCUAAUCCGCCCACAmUmU | 2519 | UGUGGGCGGAUUAGGGCUUmUmU |
| 613 | 489 | AGCCCUAAUCCGCCCACAGmUmU | 2520 | CUGUGGGCGGAUUAGGGCUmUmU |
| 614 | 490 | GCCCUAAUCCGCCCACAGGmUmU | 2521 | CCUGUGGGCGGAUUAGGGCmUmU |
| 615 | 491 | CCCUAAUCCGCCCACAGGAmUmU | 2522 | UCCUGUGGGCGGAUUAGGGmUmU |
| 616 | 492 | CCUAAUCCGCCCACAGGAAmUmU | 2523 | UUCCUGUGGGCGGAUUAGGmUmU |
| 617 | 493 | CUAAUCCGCCCACAGGAAGmUmU | 2524 | CUUCCUGUGGGCGGAUUAGmUmU |
| 618 | 494 | UAAUCCGCCCACAGGAAGCmUmU | 2525 | GCUUCCUGUGGGCGGAUUAmUmU |
| 619 | 495 | AAUCCGCCCACAGGAAGCCmUmU | 2526 | GGCUUCCUGUGGGCGGAUUmUmU |
| 620 | 496 | AUCCGCCCACAGGAAGCCUmUmU | 2527 | AGGCUUCCUGUGGGCGGAUmUmU |
| 621 | 497 | UCCGCCCACAGGAAGCCUGmUmU | 2528 | CAGGCUUCCUGUGGGCGGAmUmU |
| 622 | 498 | CCGCCCACAGGAAGCCUGCmUmU | 2529 | GCAGGCUUCCUGUGGGCGGmUmU |
| 623 | 499 | CGCCCACAGGAAGCCUGCAmUmU | 2530 | UGCAGGCUUCCUGUGGGCGmUmU |
| 624 | 500 | GCCCACAGGAAGCCUGCAGmUmU | 2531 | CUGCAGGCUUCCUGUGGGCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 625 | 501 | CCCACAGGAAGCCUGCAGUmUmU | 2532 | ACUGCAGGCUUCCUGUGGGmUmU |
| 626 | 502 | CCACAGGAAGCCUGCAGUCmUmU | 2533 | GACUGCAGGCUUCCUGUGGmUmU |
| 627 | 503 | CACAGGAAGCCUGCAGUCCmUmU | 2534 | GGACUGCAGGCUUCCUGUGmUmU |
| 628 | 504 | ACAGGAAGCCUGCAGUCCUmUmU | 2535 | AGGACUGCAGGCUUCCUGUmUmU |
| 629 | 505 | CAGGAAGCCUGCAGUCCUGmUmU | 2536 | CAGGACUGCAGGCUUCCUGmUmU |
| 630 | 506 | AGGAAGCCUGCAGUCCUGGmUmU | 2537 | CCAGGACUGCAGGCUUCCmUmU |
| 631 | 507 | GGAAGCCUGCAGUCCUGGAmUmU | 2538 | UCCAGGACUGCAGGCUUCCmUmU |
| 632 | 508 | GAAGCCUGCAGUCCUGGAAmUmU | 2539 | UUCCAGGACUGCAGGCUUCmUmU |
| 633 | 509 | AAGCCUGCAGUCCUGGAAGmUmU | 2540 | CUUCCAGGACUGCAGGCUUmUmU |
| 634 | 510 | AGCCUGCAGUCCUGGAAGCmUmU | 2541 | GCUUCCAGGACUGCAGGCUmUmU |
| 635 | 511 | GCCUGCAGUCCUGGAAGCGmUmU | 2542 | CGCUUCCAGGACUGCAGGCmUmU |
| 636 | 512 | CCUGCAGUCCUGGAAGCGCmUmU | 2543 | GCGCUUCCAGGACUGCAGGmUmU |
| 637 | 513 | CUGCAGUCCUGGAAGCGCGmUmU | 2544 | CGCGCUUCCAGGACUGCAGmUmU |
| 638 | 514 | UGCAGUCCUGGAAGCGCGAmUmU | 2545 | UCGCGCUUCCAGGACUGCAmUmU |
| 639 | 515 | GCAGUCCUGGAAGCGCGAGmUmU | 2546 | CUCGCGCUUCCAGGACUGCmUmU |
| 640 | 516 | CAGUCCUGGAAGCGCGAGGmUmU | 2547 | CCUCGCGCUUCCAGGACUGmUmU |
| 641 | 517 | AGUCCUGGAAGCGCGAGGGmUmU | 2548 | CCCUCGCGCUUCCAGGACUmUmU |
| 642 | 518 | GUCCUGGAAGCGCGAGGGCmUmU | 2549 | GCCCUCGCGCUUCCAGGACmUmU |
| 643 | 519 | UCCUGGAAGCGCGAGGGCCmUmU | 2550 | GGCCCUCGCGCUUCCAGGAmUmU |
| 644 | 520 | CCUGGAAGCGCGAGGGCCUmUmU | 2551 | AGGCCCUCGCGCUUCCAGGmUmU |
| 645 | 521 | CUGGAAGCGCGAGGGCCUCmUmU | 2552 | GAGGCCCUCGCGCUUCCAGmUmU |
| 646 | 522 | UGGAAGCGCGAGGGCCUCAmUmU | 2553 | UGAGGCCCUCGCGCUUCCAmUmU |
| 647 | 523 | GGAAGCGCGAGGGCCUCAAmUmU | 2554 | UUGAGGCCCUCGCGCUUCCmUmU |
| 648 | 524 | GAAGCGCGAGGGCCUCAAAmUmU | 2555 | UUUGAGGCCCUCGCGCUUCmUmU |
| 649 | 525 | AAGCGCGAGGGCCUCAAAGmUmU | 2556 | CUUUGAGGCCCUCGCGCUUmUmU |
| 650 | 526 | AGCGCGAGGGCCUCAAAGGmUmU | 2557 | CCUUUGAGGCCCUCGCGCUmUmU |
| 651 | 527 | GCGCGAGGGCCUCAAAGGCmUmU | 2558 | GCCUUUGAGGCCCUCGCGCmUmU |
| 652 | 528 | CGCGAGGGCCUCAAAGGCCmUmU | 2559 | GGCCUUUGAGGCCCUCGCGmUmU |
| 653 | 529 | GCGAGGGCCUCAAAGGCCCmUmU | 2560 | GGGCCUUUGAGGCCCUCGCmUmU |
| 654 | 530 | CGAGGGCCUCAAAGGCCCGmUmU | 2561 | CGGGCCUUUGAGGCCCUCGmUmU |
| 655 | 531 | GAGGGCCUCAAAGGCCCGCmUmU | 2562 | GCGGGCCUUUGAGGCCCUCmUmU |
| 656 | 532 | AGGGCCUCAAAGGCCCGCUmUmU | 2563 | AGCGGGCCUUUGAGGCCCUmUmU |
| 657 | 533 | GGGCCUCAAAGGCCCGCUCmUmU | 2564 | GAGCGGGCCUUUGAGGCCCmUmU |
| 658 | 534 | GGCCUCAAAGGCCCGCUCUmUmU | 2565 | AGAGCGGGCCUUUGAGGCCmUmU |
| 659 | 535 | GCCUCAAAGGCCCGCUCUAmUmU | 2566 | UAGAGCGGGCCUUUGAGGCmUmU |
| 660 | 536 | CCUCAAAGGCCCGCUCUACmUmU | 2567 | GUAGAGCGGGCCUUUGAGGmUmU |
| 661 | 537 | CUCAAAGGCCCGCUCUACAmUmU | 2568 | UGUAGAGCGGGCCUUUGAGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 662 | 538 | UCAAAGGCCCGCUCUACAUmUmU | 2569 | AUGUAGAGCGGGCCUUUGAmUmU |
| 663 | 539 | CAAAGGCCCGCUCUACAUCmUmU | 2570 | GAUGUAGAGCGGGCCUUUGmUmU |
| 664 | 540 | AAAGGCCCGCUCUACAUCUmUmU | 2571 | AGAUGUAGAGCGGGCCUUUmUmU |
| 665 | 541 | AAGGCCCGCUCUACAUCUUmUmU | 2572 | AAGAUGUAGAGCGGGCCUUmUmU |
| 666 | 542 | AGGCCCGCUCUACAUCUUCmUmU | 2573 | GAAGAUGUAGAGCGGGCCmUmU |
| 667 | 543 | GGCCCGCUCUACAUCUUCUmUmU | 2574 | AGAAGAUGUAGAGCGGGCmUmU |
| 668 | 544 | GCCCGCUCUACAUCUUCUGmUmU | 2575 | CAGAAGAUGUAGAGCGGGmUmU |
| 669 | 545 | CCCGCUCUACAUCUUCUGCmUmU | 2576 | GCAGAAGAUGUAGAGCGGGmUmU |
| 670 | 546 | CCGCUCUACAUCUUCUGCCmUmU | 2577 | GGCAGAAGAUGUAGAGCGGmUmU |
| 671 | 547 | CGCUCUACAUCUUCUGCCUmUmU | 2578 | AGGCAGAAGAUGUAGAGCGmUmU |
| 672 | 548 | GCUCUACAUCUUCUGCCUUmUmU | 2579 | AAGGCAGAAGAUGUAGAGCmUmU |
| 673 | 549 | CUCUACAUCUUCUGCCUUAmUmU | 2580 | UAAGGCAGAAGAUGUAGAGmUmU |
| 674 | 550 | UCUACAUCUUCUGCCUUAGmUmU | 2581 | CUAAGGCAGAAGAUGUAGAmUmU |
| 675 | 551 | CUACAUCUUCUGCCUUAGUmUmU | 2582 | ACUAAGGCAGAAGAUGUAGmUmU |
| 676 | 552 | UACAUCUUCUGCCUUAGUCmUmU | 2583 | GACUAAGGCAGAAGAUGUAmUmU |
| 677 | 553 | ACAUCUUCUGCCUUAGUCUmUmU | 2584 | AGACUAAGGCAGAAGAUGUmUmU |
| 678 | 554 | CAUCUUCUGCCUUAGUCUCmUmU | 2585 | GAGACUAAGGCAGAAGAUGmUmU |
| 679 | 555 | AUCUUCUGCCUUAGUCUCAmUmU | 2586 | UGAGACUAAGGCAGAAGAUmUmU |
| 680 | 556 | UCUUCUGCCUUAGUCUCAGmUmU | 2587 | CUGAGACUAAGGCAGAAGAmUmU |
| 681 | 557 | CUUCUGCCUUAGUCUCAGUmUmU | 2588 | ACUGAGACUAAGGCAGAAGmUmU |
| 682 | 558 | UUCUGCCUUAGUCUCAGUUmUmU | 2589 | AACUGAGACUAAGGCAGAAmUmU |
| 683 | 559 | UCUGCCUUAGUCUCAGUUUmUmU | 2590 | AAACUGAGACUAAGGCAGAmUmU |
| 684 | 560 | CUGCCUUAGUCUCAGUUUGmUmU | 2591 | CAAACUGAGACUAAGGCAGmUmU |
| 685 | 561 | UGCCUUAGUCUCAGUUUGUmUmU | 2592 | ACAAACUGAGACUAAGGCAmUmU |
| 686 | 562 | GCCUUAGUCUCAGUUUGUGmUmU | 2593 | CACAAACUGAGACUAAGGCmUmU |
| 687 | 563 | CCUUAGUCUCAGUUUGUGUmUmU | 2594 | ACACAAACUGAGACUAAGGmUmU |
| 688 | 564 | CUUAGUCUCAGUUUGUGUGmUmU | 2595 | CACACAAACUGAGACUAAGmUmU |
| 689 | 565 | UUAGUCUCAGUUUGUGUGUmUmU | 2596 | ACACACAAACUGAGACUAAmUmU |
| 690 | 566 | UAGUCUCAGUUUGUGUGUCmUmU | 2597 | GACACACAAACUGAGACUAmUmU |
| 691 | 567 | AGUCUCAGUUUGUGUGUCUmUmU | 2598 | AGACACACAAACUGAGACUmUmU |
| 692 | 568 | GUCUCAGUUUGUGUGUCUUmUmU | 2599 | AAGACACACAAACUGAGACmUmU |
| 693 | 569 | UCUCAGUUUGUGUGUCUUAmUmU | 2600 | UAAGACACACAAACUGAGAmUmU |
| 694 | 570 | CUCAGUUUGUGUGUCUUAAmUmU | 2601 | UUAAGACACACAAACUGAGmUmU |
| 695 | 571 | UCAGUUUGUGUGUCUUAAUmUmU | 2602 | AUUAAGACACACAAACUGAmUmU |
| 696 | 572 | CAGUUUGUGUGUCUUAAUUmUmU | 2603 | AAUUAAGACACACAAACUGmUmU |
| 697 | 573 | AGUUUGUGUGUCUUAAUUAmUmU | 2604 | UAAUUAAGACACACAAACUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 698 | 574 | GUUUGUGUGUCUUAAUUAUMUmU | 2605 | AUAAUUAAGACACACAAACmUmU |
| 699 | 575 | UUUGUGUGUCUUAAUUAUUMUmU | 2606 | AAUAAUUAAGACACACAAAmUmU |
| 700 | 576 | UUGUGUGUCUUAAUUAUUAMUmU | 2607 | UAAUAAUUAAGACACACAAmUmU |
| 701 | 577 | UGUGUGUCUUAAUUAUUAUMUmU | 2608 | AUAAUAAUUAAGACACACAmUmU |
| 702 | 578 | GUGUGUCUUAAUUAUUAUMUmU | 2609 | AAUAAUAAUUAAGACACACmUmU |
| 703 | 579 | UGUGUCUUAAUUAUUAUUMUmU | 2610 | AAAUAAUAAUUAAGACACAmUmU |
| 704 | 580 | GUGUCUUAAUUAUUAUUUGMUmU | 2611 | CAAAUAAUAAUUAAGACACmUmU |
| 705 | 581 | UGUCUUAAUUAUUAUUUGMUmU | 2612 | ACAAAUAAUAAUUAAGACAmUmU |
| 706 | 582 | GUCUUAAUUAUUAUUUGUGMUmU | 2613 | CACAAAUAAUAAUUAAGACmUmU |
| 707 | 583 | UCUUAAUUAUUAUUUGUGUMUmU | 2614 | ACACAAAUAAUAAUUAAGAmUmU |
| 708 | 584 | CUUAAUUAUUAUUUGUGUUMUmU | 2615 | AACACAAAUAAUAAUUAAGmUmU |
| 709 | 585 | UUAAUUAUUAUUUGUGUUUMUmU | 2616 | AAACACAAAUAAUAAUUAAmUmU |
| 710 | 586 | UAAUUAUUAUUUGUGUUUUMUmU | 2617 | AAAACACAAAUAAUAAUUAmUmU |
| 711 | 587 | AAUUAUUAUUUGUGUUUUAMUmU | 2618 | UAAAACACAAAUAAUAAUUmUmU |
| 712 | 588 | AUUAUUAUUUGUGUUUUAAMUmU | 2619 | UUAAAACACAAAUAAUAAUmUmU |
| 713 | 589 | UUAUUAUUUGUGUUUUAAUMUmU | 2620 | AUUAAAACACAAAUAAUAAmUmU |
| 714 | 590 | UAUUAUUUGUGUUUUAAUUMUmU | 2621 | AAUUAAAACACAAAUAAUAmUmU |
| 715 | 591 | AUUAUUUGUGUUUUAAUUUMUmU | 2622 | AAAUUAAAACACAAAUAAUmUmU |
| 716 | 592 | UUAUUUGUGUUUUAAUUUAMUmU | 2623 | UAAAUUAAAACACAAAUAAmUmU |
| 717 | 593 | UAUUUGUGUUUUAAUUUAAMUmU | 2624 | UUAAAUUAAAACACAAAUAmUmU |
| 718 | 594 | AUUUGUGUUUUAAUUUAAAMUmU | 2625 | UUUAAAUUAAAACACAAAUmUmU |
| 719 | 595 | UUUGUGUUUUAAUUUAAACmUmU | 2626 | GUUUAAAUUAAAACACAAAmUmU |
| 720 | 596 | UUGUGUUUUAAUUUAAACAmUmU | 2627 | UGUUUAAAUUAAAACACAAmUmU |
| 721 | 597 | UGUGUUUUAAUUUAAACACmUmU | 2628 | GUGUUUAAAUUAAAACACAmUmU |
| 722 | 598 | GUGUUUUAAUUUAAACACCmUmU | 2629 | GGUGUUUAAAUUAAAACACmUmU |
| 723 | 599 | UGUUUUAAUUUAAACACCUmUmU | 2630 | AGGUGUUUAAAUUAAAACAmUmU |
| 724 | 600 | GUUUUAAUUUAAACACCUCmUmU | 2631 | GAGGUGUUUAAAUUAAAACmUmU |
| 725 | 601 | UUUUAAUUUAAACACCUCCmUmU | 2632 | GGAGGUGUUUAAAUUAAAAmUmU |
| 726 | 602 | UUUAAUUUAAACACCUCCUmUmU | 2633 | AGGAGGUGUUUAAAUUAAAmUmU |
| 727 | 603 | UUAAUUUAAACACCUCCUCmUmU | 2634 | GAGGAGGUGUUUAAAUUAAmUmU |
| 728 | 604 | UAAUUUAAACACCUCCUCAmUmU | 2635 | UGAGGAGGUGUUUAAAUUAmUmU |
| 729 | 605 | AAUUUAAACACCUCCUCAUmUmU | 2636 | AUGAGGAGGUGUUUAAAUUmUmU |
| 730 | 606 | AUUUAAACACCUCCUCAUGmUmU | 2637 | CAUGAGGAGGUGUUUAAAUmUmU |
| 731 | 607 | UUUAAACACCUCCUCAUGUmUmU | 2638 | ACAUGAGGAGGUGUUUAAAmUmU |
| 732 | 608 | UUAAACACCUCCUCAUGUAmUmU | 2639 | UACAUGAGGAGGUGUUUAAmUmU |
| 733 | 609 | UAAACACCUCCUCAUGUACmUmU | 2640 | GUACAUGAGGAGGUGUUUAmUmU |
| 734 | 610 | AAACACCUCCUCAUGUACAmUmU | 2641 | UGUACAUGAGGAGGUGUUUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 735 | 611 | AACACCUCCUCAUGUACAUmUmU | 2642 | AUGUACAUGAGGAGGUGUUmUmU |
| 736 | 612 | ACACCUCCUCAUGUACAUAmUmU | 2643 | UAUGUACAUGAGGAGGUGUmUmU |
| 737 | 613 | CACCUCCUCAUGUACAUACmUmU | 2644 | GUAUGUACAUGAGGAGGUGmUmU |
| 738 | 614 | ACCUCCUCAUGUACAUACCmUmU | 2645 | GGUAUGUACAUGAGGAGGmUmU |
| 739 | 615 | CCUCCUCAUGUACAUACCCmUmU | 2646 | GGGUAUGUACAUGAGGAGGmUmU |
| 740 | 616 | CUCCUCAUGUACAUACCCUmUmU | 2647 | AGGGUAUGUACAUGAGGAGmUmU |
| 741 | 617 | UCCUCAUGUACAUACCCUGmUmU | 2648 | CAGGGUAUGUACAUGAGGAmUmU |
| 742 | 618 | CCUCAUGUACAUACCCUGGmUmU | 2649 | CCAGGGUAUGUACAUGAGGmUmU |
| 743 | 619 | CUCAUGUACAUACCCUGGCmUmU | 2650 | GCCAGGGUAUGUACAUGAGmUmU |
| 744 | 620 | UCAUGUACAUACCCUGGCCmUmU | 2651 | GGCCAGGGUAUGUACAUGAmUmU |
| 745 | 621 | CAUGUACAUACCCUGGCCGmUmU | 2652 | CGGCCAGGGUAUGUACAUGmUmU |
| 746 | 622 | AUGUACAUACCCUGGCCGCmUmU | 2653 | GCGGCCAGGGUAUGUACAUmUmU |
| 747 | 623 | UGUACAUACCCUGGCCGCCmUmU | 2654 | GGCGGCCAGGGUAUGUACAmUmU |
| 748 | 624 | GUACAUACCCUGGCCGCCCmUmU | 2655 | GGGCGGCCAGGGUAUGUACmUmU |
| 749 | 625 | UACAUACCCUGGCCGCCCCmUmU | 2656 | GGGGCGGCCAGGGUAUGUAmUmU |
| 750 | 626 | ACAUACCCUGGCCGCCCCCmUmU | 2657 | GGGGGCGGCCAGGGUAUGUmUmU |
| 751 | 627 | CAUACCCUGGCCGCCCCCUmUmU | 2658 | AGGGGGCGGCCAGGGUAUGmUmU |
| 752 | 628 | AUACCCUGGCCGCCCCCUGmUmU | 2659 | CAGGGGGCGGCCAGGGUAUmUmU |
| 753 | 629 | UACCCUGGCCGCCCCCUGCmUmU | 2660 | GCAGGGGGCGGCCAGGGUAmUmU |
| 754 | 630 | ACCCUGGCCGCCCCCUGCCmUmU | 2661 | GGCAGGGGGCGGCCAGGGUmUmU |
| 755 | 631 | CCCUGGCCGCCCCCUGCCCmUmU | 2662 | GGGCAGGGGGCGGCCAGGGmUmU |
| 756 | 632 | CCUGGCCGCCCCCUGCCCCmUmU | 2663 | GGGGCAGGGGGCGGCCAGGmUmU |
| 757 | 633 | CUGGCCGCCCCCUGCCCCCmUmU | 2664 | GGGGGCAGGGGGCGGCCAGmUmU |
| 758 | 634 | UGGCCGCCCCCUGCCCCCCmUmU | 2665 | GGGGGGCAGGGGGCGGCCAmUmU |
| 759 | 635 | GGCCGCCCCCUGCCCCCCAmUmU | 2666 | UGGGGGGCAGGGGGCGGCCmUmU |
| 760 | 636 | GCCGCCCCCUGCCCCCCAGmUmU | 2667 | CUGGGGGGCAGGGGGCGGCmUmU |
| 761 | 637 | CCGCCCCCUGCCCCCCAGCmUmU | 2668 | GCUGGGGGGCAGGGGGCGGmUmU |
| 762 | 638 | CGCCCCCUGCCCCCCAGCCmUmU | 2669 | GGCUGGGGGGCAGGGGGCGmUmU |
| 763 | 639 | GCCCCCUGCCCCCCAGCCUmUmU | 2670 | AGGCUGGGGGGCAGGGGGCmUmU |
| 764 | 640 | CCCCCUGCCCCCCAGCCUCmUmU | 2671 | GAGGCUGGGGGGCAGGGGGmUmU |
| 765 | 641 | CCCCUGCCCCCCAGCCUCUmUmU | 2672 | AGAGGCUGGGGGGCAGGGGmUmU |
| 766 | 642 | CCCUGCCCCCCAGCCUCUGmUmU | 2673 | CAGAGGCUGGGGGGCAGGGmUmU |
| 767 | 643 | CCUGCCCCCCAGCCUCUGGmUmU | 2674 | CCAGAGGCUGGGGGGCAGGmUmU |
| 768 | 644 | CUGCCCCCCAGCCUCUGGCmUmU | 2675 | GCCAGAGGCUGGGGGGCAGmUmU |
| 769 | 645 | UGCCCCCCAGCCUCUGGCAmUmU | 2676 | UGCCAGAGGCUGGGGGGCAmUmU |
| 770 | 646 | GCCCCCCAGCCUCUGGCAUmUmU | 2677 | AUGCCAGAGGCUGGGGGGCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 771 | 647 | CCCCCCAGCCUCUGGCAUUmUmU | 2678 | AAUGCCAGAGGCUGGGGGmUmU |
| 772 | 648 | CCCCCAGCCUCUGGCAUUAmUmU | 2679 | UAAUGCCAGAGGCUGGGGGmUmU |
| 773 | 649 | CCCCAGCCUCUGGCAUUAGmUmU | 2680 | CUAAUGCCAGAGGCUGGGGmUmU |
| 774 | 650 | CCCAGCCUCUGGCAUUAGAmUmU | 2681 | UCUAAUGCCAGAGGCUGGGmUmU |
| 775 | 651 | CCAGCCUCUGGCAUUAGAAmUmU | 2682 | UUCUAAUGCCAGAGGCUGGmUmU |
| 776 | 652 | CAGCCUCUGGCAUUAGAAUmUmU | 2683 | AUUCUAAUGCCAGAGGCUGmUmU |
| 777 | 653 | AGCCUCUGGCAUUAGAAUUmUmU | 2684 | AAUUCUAAUGCCAGAGGCUmUmU |
| 778 | 654 | GCCUCUGGCAUUAGAAUUAmUmU | 2685 | UAAUUCUAAUGCCAGAGGCmUmU |
| 779 | 655 | CCUCUGGCAUUAGAAUUAUmUmU | 2686 | AUAAUUCUAAUGCCAGAGGmUmU |
| 780 | 656 | CUCUGGCAUUAGAAUUAUUmUmU | 2687 | AAUAAUUCUAAUGCCAGAGmUmU |
| 781 | 657 | UCUGGCAUUAGAAUUAUUUmUmU | 2688 | AAAUAAUUCUAAUGCCAGAmUmU |
| 782 | 658 | CUGGCAUUAGAAUUAUUUAmUmU | 2689 | UAAAUAAUUCUAAUGCCAGmUmU |
| 783 | 659 | UGGCAUUAGAAUUAUUUAAmUmU | 2690 | UUAAAUAAUUCUAAUGCCAmUmU |
| 784 | 660 | GGCAUUAGAAUUAUUUAAAmUmU | 2691 | UUUAAAUAAUUCUAAUGCCmUmU |
| 785 | 661 | GCAUUAGAAUUAUUUAAACmUmU | 2692 | GUUUAAAUAAUUCUAAUGCmUmU |
| 786 | 662 | CAUUAGAAUUAUUUAAACAmUmU | 2693 | UGUUUAAAUAAUUCUAAUGmUmU |
| 787 | 663 | AUUAGAAUUAUUUAAACAAmUmU | 2694 | UUGUUUAAAUAAUUCUAAUmUmU |
| 788 | 664 | UUAGAAUUAUUUAAACAAAmUmU | 2695 | UUUGUUUAAAUAAUUCUAAmUmU |
| 789 | 665 | UAGAAUUAUUUAAACAAAAmUmU | 2696 | UUUUGUUUAAAUAAUUCUAmUmU |
| 790 | 666 | AGAAUUAUUUAAACAAAAAmUmU | 2697 | UUUUUGUUUAAAUAAUUCUmUmU |
| 791 | 667 | GAAUUAUUUAAACAAAAACmUmU | 2698 | GUUUUUGUUUAAAUAAUUCmUmU |
| 792 | 668 | AAUUAUUUAAACAAAAACUmUmU | 2699 | AGUUUUUGUUUAAAUAAUUmUmU |
| 793 | 669 | AUUAUUUAAACAAAAACUAmUmU | 2700 | UAGUUUUUGUUUAAAUAAUmUmU |
| 794 | 670 | UUAUUUAAACAAAAACUAGmUmU | 2701 | CUAGUUUUUGUUUAAAUAAmUmU |
| 795 | 671 | UAUUUAAACAAAAACUAGGmUmU | 2702 | CCUAGUUUUUGUUUAAAUAmUmU |
| 796 | 672 | AUUUAAACAAAAACUAGGCmUmU | 2703 | GCCUAGUUUUUGUUUAAAUmUmU |
| 797 | 673 | UUUAAACAAAAACUAGGCGmUmU | 2704 | CGCCUAGUUUUUGUUUAAAmUmU |
| 798 | 674 | UUAAACAAAAACUAGGCGGmUmU | 2705 | CCGCCUAGUUUUUGUUUAAmUmU |
| 799 | 675 | UAAACAAAAACUAGGCGGUmUmU | 2706 | ACCGCCUAGUUUUUGUUUAmUmU |
| 800 | 676 | AAACAAAAACUAGGCGGUUmUmU | 2707 | AACCGCCUAGUUUUUGUUUmUmU |
| 801 | 677 | AACAAAAACUAGGCGGUUGmUmU | 2708 | CAACCGCCUAGUUUUUGUUmUmU |
| 802 | 678 | ACAAAAACUAGGCGGUUGAmUmU | 2709 | UCAACCGCCUAGUUUUUGUmUmU |
| 803 | 679 | CAAAAACUAGGCGGUUGAAmUmU | 2710 | UUCAACCGCCUAGUUUUUGmUmU |
| 804 | 680 | AAAAACUAGGCGGUUGAAUmUmU | 2711 | AUUCAACCGCCUAGUUUUUmUmU |
| 805 | 681 | AAAACUAGGCGGUUGAAUGmUmU | 2712 | CAUUCAACCGCCUAGUUUUmUmU |
| 806 | 682 | AAACUAGGCGGUUGAAUGAmUmU | 2713 | UCAUUCAACCGCCUAGUUUmUmU |
| 807 | 683 | AACUAGGCGGUUGAAUGAGmUmU | 2714 | CUCAUUCAACCGCCUAGUUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 808 | 684 | ACUAGGCGGUUGAAUGAGAmUmU | 2715 | UCUCAUUCAACCGCCUAGmUmU |
| 809 | 685 | CUAGGCGGUUGAAUGAGAGmUmU | 2716 | CUCUCAUUCAACCGCCUAGmUmU |
| 810 | 686 | UAGGCGGUUGAAUGAGAGGmUmU | 2717 | CCUCUCAUUCAACCGCCUAmUmU |
| 811 | 687 | AGGCGGUUGAAUGAGAGGUmUmU | 2718 | ACCUCUCAUUCAACCGCCUmUmU |
| 812 | 688 | GGCGGUUGAAUGAGAGGUUmUmU | 2719 | AACCUCUCAUUCAACCGCCmUmU |
| 813 | 689 | GCGGUUGAAUGAGAGGUUCmUmU | 2720 | GAACCUCUCAUUCAACCGCmUmU |
| 814 | 690 | CGGUUGAAUGAGAGGUUCCmUmU | 2721 | GGAACCUCUCAUUCAACCGmUmU |
| 815 | 691 | GGUUGAAUGAGAGGUUCCUmUmU | 2722 | AGGAACCUCUCAUUCAACCmUmU |
| 816 | 692 | GUUGAAUGAGAGGUUCCUAmUmU | 2723 | UAGGAACCUCUCAUUCAACmUmU |
| 817 | 693 | UUGAAUGAGAGGUUCCUAAmUmU | 2724 | UUAGGAACCUCUCAUUCAAmUmU |
| 818 | 694 | UGAAUGAGAGGUUCCUAAGmUmU | 2725 | CUUAGGAACCUCUCAUUCAmUmU |
| 819 | 695 | GAAUGAGAGGUUCCUAAGAmUmU | 2726 | UCUUAGGAACCUCUCAUUCmUmU |
| 820 | 696 | AAUGAGAGGUUCCUAAGAGmUmU | 2727 | CUCUUAGGAACCUCUCAUUmUmU |
| 821 | 697 | AUGAGAGGUUCCUAAGAGUmUmU | 2728 | ACUCUUAGGAACCUCUCAUmUmU |
| 822 | 698 | UGAGAGGUUCCUAAGAGUGmUmU | 2729 | CACUCUUAGGAACCUCUCAmUmU |
| 823 | 699 | GAGAGGUUCCUAAGAGUGCmUmU | 2730 | GCACUCUUAGGAACCUCUCmUmU |
| 824 | 700 | AGAGGUUCCUAAGAGUGCUmUmU | 2731 | AGCACUCUUAGGAACCUCUmUmU |
| 825 | 701 | GAGGUUCCUAAGAGUGCUGmUmU | 2732 | CAGCACUCUUAGGAACCUCmUmU |
| 826 | 702 | AGGUUCCUAAGAGUGCUGGmUmU | 2733 | CCAGCACUCUUAGGAACCUmUmU |
| 827 | 703 | GGUUCCUAAGAGUGCUGGGmUmU | 2734 | CCCAGCACUCUUAGGAACCmUmU |
| 828 | 704 | GUUCCUAAGAGUGCUGGGCmUmU | 2735 | GCCCAGCACUCUUAGGAACmUmU |
| 829 | 705 | UUCCUAAGAGUGCUGGGCAmUmU | 2736 | UGCCCAGCACUCUUAGGAAmUmU |
| 831 | 706 | CCUAAGAGUGCUGGGCAUUmUmU | 2737 | AAUGCCCAGCACUCUUAGGmUmU |
| 832 | 707 | CUAAGAGUGCUGGGCAUUUmUmU | 2738 | AAAUGCCCAGCACUCUUAGmUmU |
| 833 | 708 | UAAGAGUGCUGGGCAUUUUmUmU | 2739 | AAAAUGCCCAGCACUCUUAmUmU |
| 834 | 709 | AAGAGUGCUGGGCAUUUUUmUmU | 2740 | AAAAAUGCCCAGCACUCUUmUmU |
| 835 | 710 | AGAGUGCUGGGCAUUUUUAmUmU | 2741 | UAAAAAUGCCCAGCACUCUmUmU |
| 836 | 711 | GAGUGCUGGGCAUUUUUAUmUmU | 2742 | AUAAAAAUGCCCAGCACUCmUmU |
| 837 | 712 | AGUGCUGGGCAUUUUUAUUmUmU | 2743 | AAUAAAAAUGCCCAGCACUmUmU |
| 838 | 713 | GUGCUGGGCAUUUUUAUUUmUmU | 2744 | AAAUAAAAAUGCCCAGCACmUmU |
| 839 | 714 | UGCUGGGCAUUUUUAUUUUmUmU | 2745 | AAAAUAAAAAUGCCCAGCAmUmU |
| 840 | 715 | GCUGGGCAUUUUUAUUUUAmUmU | 2746 | UAAAAUAAAAAUGCCCAGCmUmU |
| 841 | 716 | CUGGGCAUUUUUAUUUUAUmUmU | 2747 | AUAAAAUAAAAAUGCCCAGmUmU |
| 842 | 717 | UGGGCAUUUUUAUUUUAUGmUmU | 2748 | CAUAAAAUAAAAAUGCCCAmUmU |
| 843 | 718 | GGGCAUUUUUAUUUUAUGAmUmU | 2749 | UCAUAAAAUAAAAAUGCCCmUmU |
| 844 | 719 | GGCAUUUUUAUUUUAUGAAmUmU | 2750 | UUCAUAAAAUAAAAAUGCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 845 | 720 | GCAUUUUAUUUUAUGAAAUmU | 2751 | UUUCAUAAAAUAAAAAUGCmUmU |
| 846 | 721 | CAUUUUAUUUUAUGAAAUmUmU | 2752 | AUUUCAUAAAAUAAAAAUGmUmU |
| 847 | 722 | AUUUUAUUUUAUGAAAUAmUmU | 2753 | UAUUUCAUAAAAUAAAAAUmUmU |
| 848 | 723 | UUUUAUUUUAUGAAAUACmUmU | 2754 | GUAUUUCAUAAAAUAAAAAmUmU |
| 849 | 724 | UUUUAUUUUAUGAAAUACUmUmU | 2755 | AGUAUUUCAUAAAAUAAAAmUmU |
| 850 | 725 | UUUAUUUUAUGAAAUACUAmUmU | 2756 | UAGUAUUUCAUAAAAUAAAmUmU |
| 851 | 726 | UUAUUUUAUGAAAUACUAUmUmU | 2757 | AUAGUAUUUCAUAAAAUAAmUmU |
| 852 | 727 | UAUUUUAUGAAAUACUAUUmUmU | 2758 | AAUAGUAUUUCAUAAAAUAmUmU |
| 853 | 728 | AUUUUAUGAAAUACUAUUUmUmU | 2759 | AAAUAGUAUUUCAUAAAAUmUmU |
| 854 | 729 | UUUUAUGAAAUACUAUUUAmUmU | 2760 | UAAAUAGUAUUUCAUAAAAmUmU |
| 855 | 730 | UUUAUGAAAUACUAUUUAAmUmU | 2761 | UUAAAUAGUAUUUCAUAAAmUmU |
| 856 | 731 | UUAUGAAAUACUAUUUAAAmUmU | 2762 | UUUAAAUAGUAUUUCAUAAmUmU |
| 857 | 732 | UAUGAAAUACUAUUUAAAGmUmU | 2763 | CUUUAAAUAGUAUUUCAUAmUmU |
| 858 | 733 | AUGAAAUACUAUUUAAAGCmUmU | 2764 | GCUUUAAAUAGUAUUUCAUmUmU |
| 859 | 734 | UGAAAUACUAUUUAAAGCCmUmU | 2765 | GGCUUUAAAUAGUAUUUCAmUmU |
| 860 | 735 | GAAAUACUAUUUAAAGCCUmUmU | 2766 | AGGCUUUAAAUAGUAUUUCmUmU |
| 861 | 736 | AAAUACUAUUUAAAGCCUCmUmU | 2767 | GAGGCUUUAAAUAGUAUUUmUmU |
| 862 | 737 | AAUACUAUUUAAAGCCUCCmUmU | 2768 | GGAGGCUUUAAAUAGUAUUmUmU |
| 863 | 738 | AUACUAUUUAAAGCCUCCUmUmU | 2769 | AGGAGGCUUUAAAUAGUAUmUmU |
| 864 | 739 | UACUAUUUAAAGCCUCCUCmUmU | 2770 | GAGGAGGCUUUAAAUAGUAmUmU |
| 865 | 740 | ACUAUUUAAAGCCUCCUCAmUmU | 2771 | UGAGGAGGCUUUAAAUAGUmUmU |
| 866 | 741 | CUAUUUAAAGCCUCCUCAUmUmU | 2772 | AUGAGGAGGCUUUAAAUAGmUmU |
| 867 | 742 | UAUUUAAAGCCUCCUCAUCmUmU | 2773 | GAUGAGGAGGCUUUAAAUAmUmU |
| 868 | 743 | AUUUAAAGCCUCCUCAUCCmUmU | 2774 | GGAUGAGGAGGCUUUAAAUmUmU |
| 869 | 744 | UUUAAAGCCUCCUCAUCCCmUmU | 2775 | GGGAUGAGGAGGCUUUAAAmUmU |
| 870 | 745 | UUAAAGCCUCCUCAUCCCGmUmU | 2776 | CGGGAUGAGGAGGCUUUAAmUmU |
| 871 | 746 | UAAAGCCUCCUCAUCCCGUmUmU | 2777 | ACGGGAUGAGGAGGCUUUAmUmU |
| 872 | 747 | AAAGCCUCCUCAUCCCGUGmUmU | 2778 | CACGGGAUGAGGAGGCUUUmUmU |
| 873 | 748 | AAGCCUCCUCAUCCCGUGUmUmU | 2779 | ACACGGGAUGAGGAGGCUUmUmU |
| 874 | 749 | AGCCUCCUCAUCCCGUGUUmUmU | 2780 | AACACGGGAUGAGGAGGCUmUmU |
| 875 | 750 | GCCUCCUCAUCCCGUGUUCmUmU | 2781 | GAACACGGGAUGAGGAGGCmUmU |
| 876 | 751 | CCUCCUCAUCCCGUGUUCUmUmU | 2782 | AGAACACGGGAUGAGGAGGmUmU |
| 877 | 752 | CUCCUCAUCCCGUGUUCUCmUmU | 2783 | GAGAACACGGGAUGAGGAGmUmU |
| 878 | 753 | UCCUCAUCCCGUGUUCUCCmUmU | 2784 | GGAGAACACGGGAUGAGGAmUmU |
| 879 | 754 | CCUCAUCCCGUGUUCUCCUmUmU | 2785 | AGGAGAACACGGGAUGAGGmUmU |
| 880 | 755 | CUCAUCCCGUGUUCUCCUUmUmU | 2786 | AAGGAGAACACGGGAUGAGmUmU |
| 881 | 756 | UCAUCCCGUGUUCUCCUUUmUmU | 2787 | AAAGGAGAACACGGGAUGAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 882 | 757 | CAUCCCGUGUUCUCCUUUUmUmU | 2788 | AAAAGGAGAACACGGGAUGmUmU |
| 883 | 758 | AUCCCGUGUUCUCCUUUUCmUmU | 2789 | GAAAAGGAGAACACGGGAUmUmU |
| 884 | 759 | UCCCGUGUUCUCCUUUUCCmUmU | 2790 | GGAAAAGGAGAACACGGGAmUmU |
| 885 | 760 | CCCGUGUUCUCCUUUUCCUmUmU | 2791 | AGGAAAAGGAGAACACGGGmUmU |
| 886 | 761 | CCGUGUUCUCCUUUUCCUCmUmU | 2792 | GAGGAAAAGGAGAACACGGmUmU |
| 887 | 762 | CGUGUUCUCCUUUUCCUCUmUmU | 2793 | AGAGGAAAAGGAGAACACGmUmU |
| 888 | 763 | GUGUUCUCCUUUUCCUCUCmUmU | 2794 | GAGAGGAAAAGGAGAACACmUmU |
| 889 | 764 | UGUUCUCCUUUUCCUCUCUmUmU | 2795 | AGAGAGGAAAAGGAGAACAmUmU |
| 890 | 765 | GUUCUCCUUUUCCUCUCUCmUmU | 2796 | GAGAGAGGAAAAGGAGAACmUmU |
| 891 | 766 | UUCUCCUUUUCCUCUCUCCmUmU | 2797 | GGAGAGAGGAAAAGGAGAAmUmU |
| 892 | 767 | UCUCCUUUUCCUCUCUCCCmUmU | 2798 | GGGAGAGAGGAAAAGGAGAmUmU |
| 893 | 768 | CUCCUUUUCCUCUCUCCCGmUmU | 2799 | CGGGAGAGAGGAAAAGGAGmUmU |
| 894 | 769 | UCCUUUUCCUCUCUCCCGGmUmU | 2800 | CCGGGAGAGAGGAAAAGGAmUmU |
| 895 | 770 | CCUUUUCCUCUCUCCCGGAmUmU | 2801 | UCCGGGAGAGAGGAAAAGGmUmU |
| 896 | 771 | CUUUUCCUCUCUCCCGGAGmUmU | 2802 | CUCCGGGAGAGAGGAAAAGmUmU |
| 897 | 772 | UUUUCCUCUCUCCCGGAGGmUmU | 2803 | CCUCCGGGAGAGAGGAAAAmUmU |
| 898 | 773 | UUUCCUCUCUCCCGGAGGUmUmU | 2804 | ACCUCCGGGAGAGAGGAAAmUmU |
| 899 | 774 | UUCCUCUCUCCCGGAGGUUmUmU | 2805 | AACCUCCGGGAGAGAGGAAmUmU |
| 900 | 775 | UCCUCUCUCCCGGAGGUUGmUmU | 2806 | CAACCUCCGGGAGAGAGGAmUmU |
| 901 | 776 | CCUCUCUCCCGGAGGUUGGmUmU | 2807 | CCAACCUCCGGGAGAGAGGmUmU |
| 902 | 777 | CUCUCUCCCGGAGGUUGGGmUmU | 2808 | CCCAACCUCCGGGAGAGAGmUmU |
| 903 | 778 | UCUCUCCCGGAGGUUGGGUmUmU | 2809 | ACCCAACCUCCGGGAGAGAmUmU |
| 904 | 779 | CUCUCCCGGAGGUUGGGUGmUmU | 2810 | CACCCAACCUCCGGGAGAGmUmU |
| 905 | 780 | UCUCCCGGAGGUUGGGUGGmUmU | 2811 | CCACCCAACCUCCGGGAGAmUmU |
| 906 | 781 | CUCCCGGAGGUUGGGUGGGmUmU | 2812 | CCCACCCAACCUCCGGGAGmUmU |
| 907 | 782 | UCCCGGAGGUUGGGUGGGCmUmU | 2813 | GCCCACCCAACCUCCGGGAmUmU |
| 908 | 783 | CCCGGAGGUUGGGUGGGCCmUmU | 2814 | GGCCCACCCAACCUCCGGGmUmU |
| 909 | 784 | CCGGAGGUUGGGUGGGCCGmUmU | 2815 | CGGCCCACCCAACCUCCGGmUmU |
| 910 | 785 | CGGAGGUUGGGUGGGCCGGmUmU | 2816 | CCGGCCCACCCAACCUCCGmUmU |
| 911 | 786 | GGAGGUUGGGUGGGCCGGCmUmU | 2817 | GCCGGCCCACCCAACCUCCmUmU |
| 912 | 787 | GAGGUUGGGUGGGCCGGCUmUmU | 2818 | AGCCGGCCCACCCAACCUCmUmU |
| 913 | 788 | AGGUUGGGUGGGCCGGCUUmUmU | 2819 | AAGCCGGCCCACCCAACCUmUmU |
| 914 | 789 | GGUUGGGUGGGCCGGCUUCmUmU | 2820 | GAAGCCGGCCCACCCAACCmUmU |
| 915 | 790 | GUUGGGUGGGCCGGCUUCAmUmU | 2821 | UGAAGCCGGCCCACCCAACmUmU |
| 916 | 791 | UUGGGUGGGCCGGCUUCAUmUmU | 2822 | AUGAAGCCGGCCCACCCAAmUmU |
| 917 | 792 | UGGGUGGGCCGGCUUCAUGmUmU | 2823 | CAUGAAGCCGGCCCACCCAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 918 | 793 | GGGUGGGCCGGCUUCAUGCCmUmU | 2824 | GCAUGAAGCCGGCCCACCCmUmU |
| 919 | 794 | GGUGGGCCGGCUUCAUGCCmUmU | 2825 | GGCAUGAAGCCGGCCCACCmUmU |
| 920 | 795 | GUGGGCCGGCUUCAUGCCAmUmU | 2826 | UGGCAUGAAGCCGGCCCACmUmU |
| 921 | 796 | UGGGCCGGCUUCAUGCCAGmUmU | 2827 | CUGGCAUGAAGCCGGCCCAmUmU |
| 922 | 797 | GGGCCGGCUUCAUGCCAGCmUmU | 2828 | GCUGGCAUGAAGCCGGCCCmUmU |
| 923 | 798 | GGCCGGCUUCAUGCCAGCUmUmU | 2829 | AGCUGGCAUGAAGCCGGCCmUmU |
| 924 | 799 | GCCGGCUUCAUGCCAGCUAmUmU | 2830 | UAGCUGGCAUGAAGCCGGCmUmU |
| 925 | 800 | CCGGCUUCAUGCCAGCUACmUmU | 2831 | GUAGCUGGCAUGAAGCCGGmUmU |
| 926 | 801 | CGGCUUCAUGCCAGCUACUmUmU | 2832 | AGUAGCUGGCAUGAAGCCGmUmU |
| 927 | 802 | GGCUUCAUGCCAGCUACUUmUmU | 2833 | AAGUAGCUGGCAUGAAGCCmUmU |
| 928 | 803 | GCUUCAUGCCAGCUACUUCmUmU | 2834 | GAAGUAGCUGGCAUGAAGCmUmU |
| 929 | 804 | CUUCAUGCCAGCUACUUCCmUmU | 2835 | GGAAGUAGCUGGCAUGAAGmUmU |
| 930 | 805 | UUCAUGCCAGCUACUUCCUmUmU | 2836 | AGGAAGUAGCUGGCAUGAAmUmU |
| 931 | 806 | UCAUGCCAGCUACUUCCUCmUmU | 2837 | GAGGAAGUAGCUGGCAUGAmUmU |
| 932 | 807 | CAUGCCAGCUACUUCCUCCmUmU | 2838 | GGAGGAAGUAGCUGGCAUGmUmU |
| 933 | 808 | AUGCCAGCUACUUCCUCCUmUmU | 2839 | AGGAGGAAGUAGCUGGCAUmUmU |
| 934 | 809 | UGCCAGCUACUUCCUCCUCmUmU | 2840 | GAGGAGGAAGUAGCUGGCAmUmU |
| 935 | 810 | GCCAGCUACUUCCUCCUCCmUmU | 2841 | GGAGGAGGAAGUAGCUGGCmUmU |
| 936 | 811 | CCAGCUACUUCCUCCUCCCmUmU | 2842 | GGGAGGAGGAAGUAGCUGGmUmU |
| 937 | 812 | CAGCUACUUCCUCCUCCCCmUmU | 2843 | GGGGAGGAGGAAGUAGCUGmUmU |
| 938 | 813 | AGCUACUUCCUCCUCCCCAmUmU | 2844 | UGGGGAGGAGGAAGUAGCUmUmU |
| 939 | 814 | GCUACUUCCUCCUCCCCACmUmU | 2845 | GUGGGGAGGAGGAAGUAGCmUmU |
| 940 | 815 | CUACUUCCUCCUCCCCACUmUmU | 2846 | AGUGGGGAGGAGGAAGUAGmUmU |
| 941 | 816 | UACUUCCUCCUCCCCACUUmUmU | 2847 | AAGUGGGGAGGAGGAAGUAmUmU |
| 942 | 817 | ACUUCCUCCUCCCCACUUGmUmU | 2848 | CAAGUGGGGAGGAGGAAGUmUmU |
| 943 | 818 | CUUCCUCCUCCCCACUUGUmUmU | 2849 | ACAAGUGGGGAGGAGGAAGmUmU |
| 944 | 819 | UUCCUCCUCCCCACUUGUCmUmU | 2850 | GACAAGUGGGGAGGAGGAAmUmU |
| 945 | 820 | UCCUCCUCCCCACUUGUCCmUmU | 2851 | GGACAAGUGGGGAGGAGGAmUmU |
| 946 | 821 | CCUCCUCCCCACUUGUCCGmUmU | 2852 | CGGACAAGUGGGGAGGAGGmUmU |
| 947 | 822 | CUCCUCCCCACUUGUCCGCmUmU | 2853 | GCGGACAAGUGGGGAGGAGmUmU |
| 948 | 823 | UCCUCCCCACUUGUCCGCUmUmU | 2854 | AGCGGACAAGUGGGGAGGAmUmU |
| 949 | 824 | CCUCCCCACUUGUCCGCUGmUmU | 2855 | CAGCGGACAAGUGGGGAGGmUmU |
| 950 | 825 | CUCCCCACUUGUCCGCUGGmUmU | 2856 | CCAGCGGACAAGUGGGGAGmUmU |
| 951 | 826 | UCCCCACUUGUCCGCUGGGmUmU | 2857 | CCCAGCGGACAAGUGGGGAmUmU |
| 952 | 827 | CCCCACUUGUCCGCUGGGUmUmU | 2858 | ACCCAGCGGACAAGUGGGGmUmU |
| 953 | 828 | CCCACUUGUCCGCUGGGUGmUmU | 2859 | CACCCAGCGGACAAGUGGGmUmU |
| 954 | 829 | CCACUUGUCCGCUGGGUGGmUmU | 2860 | CCACCCAGCGGACAAGUGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 955 | 830 | CACUUGUCCGCUGGGUGGUmUmU | 2861 | ACCACCCAGCGGACAAGUGmUmU |
| 956 | 831 | ACUUGUCCGCUGGGUGGUAmUmU | 2862 | UACCACCCAGCGGACAAGUmUmU |
| 957 | 832 | CUUGUCCGCUGGGUGGUACmUmU | 2863 | GUACCACCCAGCGGACAAGmUmU |
| 958 | 833 | UUGUCCGCUGGGUGGUACCmUmU | 2864 | GGUACCACCCAGCGGACAAmUmU |
| 959 | 834 | UGUCCGCUGGGUGGUACCCmUmU | 2865 | GGGUACCACCCAGCGGACAmUmU |
| 960 | 835 | GUCCGCUGGGUGGUACCCUmUmU | 2866 | AGGGUACCACCCAGCGGACmUmU |
| 961 | 836 | UCCGCUGGGUGGUACCCUCmUmU | 2867 | GAGGGUACCACCCAGCGGAmUmU |
| 962 | 837 | CCGCUGGGUGGUACCCUCUmUmU | 2868 | AGAGGGUACCACCCAGCGGmUmU |
| 963 | 838 | CGCUGGGUGGUACCCUCUGmUmU | 2869 | CAGAGGGUACCACCCAGCGmUmU |
| 964 | 839 | GCUGGGUGGUACCCUCUGGmUmU | 2870 | CCAGAGGGUACCACCCAGCmUmU |
| 965 | 840 | CUGGGUGGUACCCUCUGGAmUmU | 2871 | UCCAGAGGGUACCACCCAGmUmU |
| 966 | 841 | UGGGUGGUACCCUCUGGAGmUmU | 2872 | CUCCAGAGGGUACCACCCAmUmU |
| 967 | 842 | GGGUGGUACCCUCUGGAGGmUmU | 2873 | CCUCCAGAGGGUACCACCCmUmU |
| 968 | 843 | GGUGGUACCCUCUGGAGGGmUmU | 2874 | CCCUCCAGAGGGUACCACCmUmU |
| 969 | 844 | GUGGUACCCUCUGGAGGGGmUmU | 2875 | CCCCUCCAGAGGGUACCACmUmU |
| 970 | 845 | UGGUACCCUCUGGAGGGGUmUmU | 2876 | ACCCCUCCAGAGGGUACCAmUmU |
| 971 | 846 | GGUACCCUCUGGAGGGGUGmUmU | 2877 | CACCCCUCCAGAGGGUACCmUmU |
| 972 | 847 | GUACCCUCUGGAGGGGUGUmUmU | 2878 | ACACCCCUCCAGAGGGUACmUmU |
| 973 | 848 | UACCCUCUGGAGGGGUGUGmUmU | 2879 | CACACCCCUCCAGAGGGUAmUmU |
| 974 | 849 | ACCCUCUGGAGGGGUGUGGmUmU | 2880 | CCACACCCCUCCAGAGGGUmUmU |
| 975 | 850 | CCCUCUGGAGGGGUGUGGCmUmU | 2881 | GCCACACCCCUCCAGAGGGmUmU |
| 976 | 851 | CCUCUGGAGGGGUGUGGCUmUmU | 2882 | AGCCACACCCCUCCAGAGGmUmU |
| 977 | 852 | CUCUGGAGGGGUGUGGCUCmUmU | 2883 | GAGCCACACCCCUCCAGAGmUmU |
| 978 | 853 | UCUGGAGGGGUGUGGCUCCmUmU | 2884 | GGAGCCACACCCCUCCAGAmUmU |
| 979 | 854 | CUGGAGGGGUGUGGCUCCUmUmU | 2885 | AGGAGCCACACCCCUCCAGmUmU |
| 980 | 855 | UGGAGGGGUGUGGCUCCUUmUmU | 2886 | AAGGAGCCACACCCCUCCAmUmU |
| 981 | 856 | GGAGGGGUGUGGCUCCUUCmUmU | 2887 | GAAGGAGCCACACCCCUCCmUmU |
| 982 | 857 | GAGGGGUGUGGCUCCUUCCmUmU | 2888 | GGAAGGAGCCACACCCCUCmUmU |
| 983 | 858 | AGGGGUGUGGCUCCUUCCCmUmU | 2889 | GGGAAGGAGCCACACCCCUmUmU |
| 984 | 859 | GGGGUGUGGCUCCUUCCCAmUmU | 2890 | UGGGAAGGAGCCACACCCCmUmU |
| 985 | 860 | GGGUGUGGCUCCUUCCCAUmUmU | 2891 | AUGGGAAGGAGCCACACCCmUmU |
| 986 | 861 | GGUGUGGCUCCUUCCCAUCmUmU | 2892 | GAUGGGAAGGAGCCACACCmUmU |
| 987 | 862 | GUGUGGCUCCUUCCCAUCGmUmU | 2893 | CGAUGGGAAGGAGCCACACmUmU |
| 988 | 863 | UGUGGCUCCUUCCCAUCGCmUmU | 2894 | GCGAUGGGAAGGAGCCACAmUmU |
| 989 | 864 | GUGGCUCCUUCCCAUCGCUmUmU | 2895 | AGCGAUGGGAAGGAGCCACmUmU |
| 990 | 865 | UGGCUCCUUCCCAUCGCUGmUmU | 2896 | CAGCGAUGGGAAGGAGCCAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 991 | 866 | GGCUCCUUCCCAUCGCUGUmUmU | 2897 | ACAGCGAUGGGAAGGAGCCmUmU |
| 992 | 867 | GCUCCUUCCCAUCGCUGUCmUmU | 2898 | GACAGCGAUGGGAAGGAGCmUmU |
| 993 | 868 | CUCCUUCCCAUCGCUGUCAmUmU | 2899 | UGACAGCGAUGGGAAGGAGmUmU |
| 994 | 869 | UCCUUCCCAUCGCUGUCACmUmU | 2900 | GUGACAGCGAUGGGAAGGAmUmU |
| 995 | 870 | CCUUCCCAUCGCUGUCACAmUmU | 2901 | UGUGACAGCGAUGGGAAGGmUmU |
| 996 | 871 | CUUCCCAUCGCUGUCACAGmUmU | 2902 | CUGUGACAGCGAUGGGAAGmUmU |
| 997 | 872 | UUCCCAUCGCUGUCACAGGmUmU | 2903 | CCUGUGACAGCGAUGGGAAmUmU |
| 998 | 873 | UCCCAUCGCUGUCACAGGCmUmU | 2904 | GCCUGUGACAGCGAUGGGAmUmU |
| 999 | 874 | CCCAUCGCUGUCACAGGCGmUmU | 2905 | CGCCUGUGACAGCGAUGGGmUmU |
| 1000 | 875 | CCAUCGCUGUCACAGGCGGmUmU | 2906 | CCGCCUGUGACAGCGAUGGmUmU |
| 1001 | 876 | CAUCGCUGUCACAGGCGGUmUmU | 2907 | ACCGCCUGUGACAGCGAUGmUmU |
| 1002 | 877 | AUCGCUGUCACAGGCGGUUmUmU | 2908 | AACCGCCUGUGACAGCGAUmUmU |
| 1003 | 878 | UCGCUGUCACAGGCGGUUAmUmU | 2909 | UAACCGCCUGUGACAGCGAmUmU |
| 1004 | 879 | CGCUGUCACAGGCGGUUAUmUmU | 2910 | AUAACCGCCUGUGACAGCGmUmU |
| 1005 | 880 | GCUGUCACAGGCGGUUAUGmUmU | 2911 | CAUAACCGCCUGUGACAGCmUmU |
| 1006 | 881 | CUGUCACAGGCGGUUAUGAmUmU | 2912 | UCAUAACCGCCUGUGACAGmUmU |
| 1007 | 882 | UGUCACAGGCGGUUAUGAAmUmU | 2913 | UUCAUAACCGCCUGUGACAmUmU |
| 1008 | 883 | GUCACAGGCGGUUAUGAAAmUmU | 2914 | UUUCAUAACCGCCUGUGACmUmU |
| 1009 | 884 | UCACAGGCGGUUAUGAAAUmUmU | 2915 | AUUUCAUAACCGCCUGUGAmUmU |
| 1010 | 885 | CACAGGCGGUUAUGAAAUUmUmU | 2916 | AAUUUCAUAACCGCCUGUGmUmU |
| 1011 | 886 | ACAGGCGGUUAUGAAAUUCmUmU | 2917 | GAAUUUCAUAACCGCCUGUmUmU |
| 1012 | 887 | CAGGCGGUUAUGAAAUUCAmUmU | 2918 | UGAAUUUCAUAACCGCCUGmUmU |
| 1013 | 888 | AGGCGGUUAUGAAAUUCACmUmU | 2919 | GUGAAUUUCAUAACCGCCUmUmU |
| 1014 | 889 | GGCGGUUAUGAAAUUCACCmUmU | 2920 | GGUGAAUUUCAUAACCGCCmUmU |
| 1015 | 890 | GCGGUUAUGAAAUUCACCCmUmU | 2921 | GGGUGAAUUUCAUAACCGCmUmU |
| 1016 | 891 | CGGUUAUGAAAUUCACCCCmUmU | 2922 | GGGGUGAAUUUCAUAACCGmUmU |
| 1017 | 892 | GGUUAUGAAAUUCACCCCCmUmU | 2923 | GGGGGUGAAUUUCAUAACCmUmU |
| 1018 | 893 | GUUAUGAAAUUCACCCCCUmUmU | 2924 | AGGGGGUGAAUUUCAUAACmUmU |
| 1019 | 894 | UUAUGAAAUUCACCCCCUUmUmU | 2925 | AAGGGGGUGAAUUUCAUAAmUmU |
| 1020 | 895 | UAUGAAAUUCACCCCCUUUmUmU | 2926 | AAAGGGGGUGAAUUUCAUAmUmU |
| 1021 | 896 | AUGAAAUUCACCCCCUUUCmUmU | 2927 | GAAAGGGGGUGAAUUUCAUmUmU |
| 1022 | 897 | UGAAAUUCACCCCCUUUCCmUmU | 2928 | GGAAAGGGGGUGAAUUUCAmUmU |
| 1023 | 898 | GAAAUUCACCCCCUUUCCUmUmU | 2929 | AGGAAAGGGGGUGAAUUUCmUmU |
| 1024 | 899 | AAAUUCACCCCCUUUCCUGmUmU | 2930 | CAGGAAAGGGGGUGAAUUUmUmU |
| 1025 | 900 | AAUUCACCCCCUUUCCUGGmUmU | 2931 | CCAGGAAAGGGGGUGAAUUmUmU |
| 1026 | 901 | AUUCACCCCCUUUCCUGGAmUmU | 2932 | UCCAGGAAAGGGGGUGAAUmUmU |
| 1027 | 902 | UUCACCCCCUUUCCUGGACmUmU | 2933 | GUCCAGGAAAGGGGGUGAAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1028 | 903 | UCACCCCCUUUCCUGGACAmUmU | 2934 | UGUCCAGGAAAGGGGGUGAmUmU |
| 1029 | 904 | CACCCCCUUUCCUGGACACmUmU | 2935 | GUGUCCAGGAAAGGGGGUGmUmU |
| 1030 | 905 | ACCCCCUUUCCUGGACACUmUmU | 2936 | AGUGUCCAGGAAAGGGGGUmUmU |
| 1031 | 906 | CCCCCUUUCCUGGACACUCmUmU | 2937 | GAGUGUCCAGGAAAGGGGmUmU |
| 1032 | 907 | CCCCUUUCCUGGACACUCAmUmU | 2938 | UGAGUGUCCAGGAAAGGGmUmU |
| 1033 | 908 | CCCUUUCCUGGACACUCAGmUmU | 2939 | CUGAGUGUCCAGGAAAGGGmUmU |
| 1034 | 909 | CCUUUCCUGGACACUCAGAmUmU | 2940 | UCUGAGUGUCCAGGAAAGGmUmU |
| 1035 | 910 | CUUUCCUGGACACUCAGACmUmU | 2941 | GUCUGAGUGUCCAGGAAAGmUmU |
| 1036 | 911 | UUUCCUGGACACUCAGACCmUmU | 2942 | GGUCUGAGUGUCCAGGAAAmUmU |
| 1037 | 912 | UUCCUGGACACUCAGACCUmUmU | 2943 | AGGUCUGAGUGUCCAGGAAmUmU |
| 1038 | 913 | UCCUGGACACUCAGACCUGmUmU | 2944 | CAGGUCUGAGUGUCCAGGAmUmU |
| 1039 | 914 | CCUGGACACUCAGACCUGAmUmU | 2945 | UCAGGUCUGAGUGUCCAGGmUmU |
| 1040 | 915 | CUGGACACUCAGACCUGAAmUmU | 2946 | UUCAGGUCUGAGUGUCCAGmUmU |
| 1041 | 916 | UGGACACUCAGACCUGAAUmUmU | 2947 | AUUCAGGUCUGAGUGUCCAmUmU |
| 1042 | 917 | GGACACUCAGACCUGAAUUmUmU | 2948 | AAUUCAGGUCUGAGUGUCCmUmU |
| 1043 | 918 | GACACUCAGACCUGAAUUCmUmU | 2949 | GAAUUCAGGUCUGAGUGUCmUmU |
| 1044 | 919 | ACACUCAGACCUGAAUUCUmUmU | 2950 | AGAAUUCAGGUCUGAGUGUmUmU |
| 1045 | 920 | CACUCAGACCUGAAUUCUUmUmU | 2951 | AAGAAUUCAGGUCUGAGUGmUmU |
| 1046 | 921 | ACUCAGACCUGAAUUCUUUmUmU | 2952 | AAAGAAUUCAGGUCUGAGUmUmU |
| 1047 | 922 | CUCAGACCUGAAUUCUUUUmUmU | 2953 | AAAAGAAUUCAGGUCUGAGmUmU |
| 1048 | 923 | UCAGACCUGAAUUCUUUUUmUmU | 2954 | AAAAAGAAUUCAGGUCUGAmUmU |
| 1049 | 924 | CAGACCUGAAUUCUUUUUCmUmU | 2955 | GAAAAAGAAUUCAGGUCUGmUmU |
| 1050 | 925 | AGACCUGAAUUCUUUUUCAmUmU | 2956 | UGAAAAAGAAUUCAGGUCUmUmU |
| 1051 | 926 | GACCUGAAUUCUUUUUCAUmUmU | 2957 | AUGAAAAAGAAUUCAGGUCmUmU |
| 1052 | 927 | ACCUGAAUUCUUUUUCAUmUmU | 2958 | AAUGAAAAAGAAUUCAGGUmUmU |
| 1053 | 928 | CCUGAAUUCUUUUUCAUUmUmU | 2959 | AAAUGAAAAAGAAUUCAGGmUmU |
| 1054 | 929 | CUGAAUUCUUUUUCAUUUGmUmU | 2960 | CAAAUGAAAAAGAAUUCAGmUmU |
| 1055 | 930 | UGAAUUCUUUUUCAUUUGAmUmU | 2961 | UCAAAUGAAAAAGAAUUCAmUmU |
| 1056 | 931 | GAAUUCUUUUUCAUUUGAGmUmU | 2962 | CUCAAAUGAAAAAGAAUUCmUmU |
| 1057 | 932 | AAUUCUUUUUCAUUUGAGAmUmU | 2963 | UCUCAAAUGAAAAAGAAUUmUmU |
| 1058 | 933 | AUUCUUUUUCAUUUGAGAAmUmU | 2964 | UUCUCAAAUGAAAAAGAAUmUmU |
| 1059 | 934 | UUCUUUUUCAUUUGAGAAGmUmU | 2965 | CUUCUCAAAUGAAAAAGAAmUmU |
| 1060 | 935 | UCUUUUUCAUUUGAGAAGUmUmU | 2966 | ACUUCUCAAAUGAAAAAGAmUmU |
| 1061 | 936 | CUUUUUCAUUUGAGAAGUAmUmU | 2967 | UACUUCUCAAAUGAAAAAGmUmU |
| 1062 | 937 | UUUUUCAUUUGAGAAGUAAmUmU | 2968 | UUACUUCUCAAAUGAAAAAmUmU |
| 1063 | 938 | UUUUCAUUUGAGAAGUAAAmUmU | 2969 | UUUACUUCUCAAAUGAAAAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1064 | 939 | UUUCAUUUGAGAAGUAAACmUmU | 2970 | GUUUACUUCUCAAAUGAAmUmU |
| 1065 | 940 | UUCAUUUGAGAAGUAAACAmUmU | 2971 | UGUUUACUUCUCAAAUGAAmUmU |
| 1066 | 941 | UCAUUUGAGAAGUAAACAGmUmU | 2972 | CUGUUUACUUCUCAAAUGAmUmU |
| 1067 | 942 | CAUUUGAGAAGUAAACAGAmUmU | 2973 | UCUGUUUACUUCUCAAAUGmUmU |
| 1068 | 943 | AUUUGAGAAGUAAACAGAUmUmU | 2974 | AUCUGUUUACUUCUCAAAUmUmU |
| 1069 | 944 | UUUGAGAAGUAAACAGAUGmUmU | 2975 | CAUCUGUUUACUUCUCAAAmUmU |
| 1070 | 945 | UUGAGAAGUAAACAGAUGGmUmU | 2976 | CCAUCUGUUUACUUCUCAAmUmU |
| 1071 | 946 | UGAGAAGUAAACAGAUGGCmUmU | 2977 | GCCAUCUGUUUACUUCUCAmUmU |
| 1072 | 947 | GAGAAGUAAACAGAUGGCAmUmU | 2978 | UGCCAUCUGUUUACUUCUCmUmU |
| 1073 | 948 | AGAAGUAAACAGAUGGCACmUmU | 2979 | GUGCCAUCUGUUUACUUCmUmU |
| 1074 | 949 | GAAGUAAACAGAUGGCACUmUmU | 2980 | AGUGCCAUCUGUUUACUUCmUmU |
| 1075 | 950 | AAGUAAACAGAUGGCACUUmUmU | 2981 | AAGUGCCAUCUGUUUACUUmUmU |
| 1076 | 951 | AGUAAACAGAUGGCACUUUmUmU | 2982 | AAAGUGCCAUCUGUUUACUmUmU |
| 1077 | 952 | GUAAACAGAUGGCACUUUGmUmU | 2983 | CAAAGUGCCAUCUGUUUACmUmU |
| 1078 | 953 | UAAACAGAUGGCACUUUGAmUmU | 2984 | UCAAAGUGCCAUCUGUUUAmUmU |
| 1079 | 954 | AAACAGAUGGCACUUUGAAmUmU | 2985 | UUCAAAGUGCCAUCUGUUUmUmU |
| 1080 | 955 | AACAGAUGGCACUUUGAAGmUmU | 2986 | CUUCAAAGUGCCAUCUGUUmUmU |
| 1081 | 956 | ACAGAUGGCACUUUGAAGGmUmU | 2987 | CCUUCAAAGUGCCAUCUGUmUmU |
| 1082 | 957 | CAGAUGGCACUUUGAAGGGmUmU | 2988 | CCCUUCAAAGUGCCAUCUGmUmU |
| 1083 | 958 | AGAUGGCACUUUGAAGGGGmUmU | 2989 | CCCCUUCAAAGUGCCAUCUmUmU |
| 1084 | 959 | GAUGGCACUUUGAAGGGGCmUmU | 2990 | GCCCCUUCAAAGUGCCAUCmUmU |
| 1085 | 960 | AUGGCACUUUGAAGGGGCCmUmU | 2991 | GGCCCCUUCAAAGUGCCAUmUmU |
| 1086 | 961 | UGGCACUUUGAAGGGGCCUmUmU | 2992 | AGGCCCCUUCAAAGUGCCAmUmU |
| 1087 | 962 | GGCACUUUGAAGGGGCCUCmUmU | 2993 | GAGGCCCCUUCAAAGUGCCmUmU |
| 1088 | 963 | GCACUUUGAAGGGGCCUCAmUmU | 2994 | UGAGGCCCCUUCAAAGUGCmUmU |
| 1089 | 964 | CACUUUGAAGGGGCCUCACmUmU | 2995 | GUGAGGCCCCUUCAAAGUGmUmU |
| 1090 | 965 | ACUUUGAAGGGGCCUCACCmUmU | 2996 | GGUGAGGCCCCUUCAAAGUmUmU |
| 1091 | 966 | CUUUGAAGGGGCCUCACCGmUmU | 2997 | CGGUGAGGCCCCUUCAAAGmUmU |
| 1092 | 967 | UUUGAAGGGGCCUCACCGAmUmU | 2998 | UCGGUGAGGCCCCUUCAAAmUmU |
| 1093 | 968 | UUGAAGGGGCCUCACCGAGmUmU | 2999 | CUCGGUGAGGCCCCUUCAAmUmU |
| 1094 | 969 | UGAAGGGGCCUCACCGAGUmUmU | 3000 | ACUCGGUGAGGCCCCUUCAmUmU |
| 1095 | 970 | GAAGGGGCCUCACCGAGUGmUmU | 3001 | CACUCGGUGAGGCCCCUUCmUmU |
| 1096 | 971 | AAGGGGCCUCACCGAGUGGmUmU | 3002 | CCACUCGGUGAGGCCCCUUmUmU |
| 1097 | 972 | AGGGGCCUCACCGAGUGGGmUmU | 3003 | CCCACUCGGUGAGGCCCCUmUmU |
| 1098 | 973 | GGGGCCUCACCGAGUGGGGmUmU | 3004 | CCCCACUCGGUGAGGCCCCmUmU |
| 1099 | 974 | GGGCCUCACCGAGUGGGGGmUmU | 3005 | CCCCCACUCGGUGAGGCCCmUmU |
| 1100 | 975 | GGCCUCACCGAGUGGGGGCmUmU | 3006 | GCCCCCACUCGGUGAGGCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1101 | 976 | GCCUCACCGAGUGGGGGCAmUmU | 3007 | UGCCCCCACUCGGUGAGGCmUmU |
| 1102 | 977 | CCUCACCGAGUGGGGGCAUmUmU | 3008 | AUGCCCCCACUCGGUGAGGmUmU |
| 1103 | 978 | CUCACCGAGUGGGGGCAUCmUmU | 3009 | GAUGCCCCCACUCGGUGAGmUmU |
| 1104 | 979 | UCACCGAGUGGGGGCAUCAmUmU | 3010 | UGAUGCCCCCACUCGGUGAmUmU |
| 1105 | 980 | CACCGAGUGGGGGCAUCAUmUmU | 3011 | AUGAUGCCCCCACUCGGUGmUmU |
| 1106 | 981 | ACCGAGUGGGGGCAUCAUCmUmU | 3012 | GAUGAUGCCCCCACUCGGUmUmU |
| 1107 | 982 | CCGAGUGGGGGCAUCAUCAmUmU | 3013 | UGAUGAUGCCCCCACUCGGmUmU |
| 1108 | 983 | CGAGUGGGGGCAUCAUCAAmUmU | 3014 | UUGAUGAUGCCCCCACUCGmUmU |
| 1109 | 984 | GAGUGGGGGCAUCAUCAAAmUmU | 3015 | UUUGAUGAUGCCCCCACUCmUmU |
| 1110 | 985 | AGUGGGGGCAUCAUCAAAAmUmU | 3016 | UUUUGAUGAUGCCCCCACUmUmU |
| 1111 | 986 | GUGGGGGCAUCAUCAAAAAmUmU | 3017 | UUUUUGAUGAUGCCCCCACmUmU |
| 1112 | 987 | UGGGGGCAUCAUCAAAAACmUmU | 3018 | GUUUUUGAUGAUGCCCCCAmUmU |
| 1113 | 988 | GGGGGCAUCAUCAAAAACUmUmU | 3019 | AGUUUUUGAUGAUGCCCCmUmU |
| 1114 | 989 | GGGGCAUCAUCAAAAACUUmUmU | 3020 | AAGUUUUUGAUGAUGCCCmUmU |
| 1115 | 990 | GGGCAUCAUCAAAAACUUUmUmU | 3021 | AAAGUUUUUGAUGAUGCCmUmU |
| 1116 | 991 | GGCAUCAUCAAAAACUUUGmUmU | 3022 | CAAAGUUUUUGAUGAUGCmUmU |
| 1117 | 992 | GCAUCAUCAAAAACUUUGGmUmU | 3023 | CCAAAGUUUUUGAUGAUGCmUmU |
| 1118 | 993 | CAUCAUCAAAAACUUUGGAmUmU | 3024 | UCCAAAGUUUUUGAUGAUGmUmU |
| 1119 | 994 | AUCAUCAAAAACUUUGGAGmUmU | 3025 | CUCCAAAGUUUUUGAUGAUmUmU |
| 1120 | 995 | UCAUCAAAAACUUUGGAGUmUmU | 3026 | ACUCCAAAGUUUUUGAUGAmUmU |
| 1121 | 996 | CAUCAAAAACUUUGGAGUCmUmU | 3027 | GACUCCAAAGUUUUUGAUGmUmU |
| 1122 | 997 | AUCAAAAACUUUGGAGUCCmUmU | 3028 | GGACUCCAAAGUUUUUGAUmUmU |
| 1123 | 998 | UCAAAAACUUUGGAGUCCCmUmU | 3029 | GGGACUCCAAAGUUUUUGAmUmU |
| 1124 | 999 | CAAAAACUUUGGAGUCCCCmUmU | 3030 | GGGGACUCCAAAGUUUUUGmUmU |
| 1125 | 1000 | AAAAACUUUGGAGUCCCCUmUmU | 3031 | AGGGGACUCCAAAGUUUUUmUmU |
| 1126 | 1001 | AAAACUUUGGAGUCCCCUCmUmU | 3032 | GAGGGGACUCCAAAGUUUUmUmU |
| 1127 | 1002 | AAACUUUGGAGUCCCCUCAmUmU | 3033 | UGAGGGGACUCCAAAGUUUmUmU |
| 1128 | 1003 | AACUUUGGAGUCCCCUCACmUmU | 3034 | GUGAGGGGACUCCAAAGUUmUmU |
| 1129 | 1004 | ACUUUGGAGUCCCCUCACCmUmU | 3035 | GGUGAGGGGACUCCAAAGUmUmU |
| 1130 | 1005 | CUUUGGAGUCCCCUCACCUmUmU | 3036 | AGGUGAGGGGACUCCAAAGmUmU |
| 1131 | 1006 | UUUGGAGUCCCCUCACCUCmUmU | 3037 | GAGGUGAGGGGACUCCAAAmUmU |
| 1132 | 1007 | UUGGAGUCCCCUCACCUCCmUmU | 3038 | GGAGGUGAGGGGACUCCAAmUmU |
| 1133 | 1008 | UGGAGUCCCCUCACCUCCUmUmU | 3039 | AGGAGGUGAGGGGACUCCAmUmU |
| 1134 | 1009 | GGAGUCCCCUCACCUCCUCmUmU | 3040 | GAGGAGGUGAGGGGACUCCmUmU |
| 1135 | 1010 | GAGUCCCCUCACCUCCUCUmUmU | 3041 | AGAGGAGGUGAGGGGACUCmUmU |
| 1136 | 1011 | AGUCCCCUCACCUCCUCUAmUmU | 3042 | UAGAGGAGGUGAGGGGACUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1137 | 1012 | GUCCCCUCACCUCCUCUAAmUmU | 3043 | UUAGAGGAGGUGAGGGGACmUmU |
| 1138 | 1013 | UCCCCUCACCUCCUCUAAGmUmU | 3044 | CUUAGAGGAGGUGAGGGGAmUmU |
| 1139 | 1014 | CCCCUCACCUCCUCUAAGGmUmU | 3045 | CCUUAGAGGAGGUGAGGGGmUmU |
| 1140 | 1015 | CCCUCACCUCCUCUAAGGUmUmU | 3046 | ACCUUAGAGGAGGUGAGGGmUmU |
| 1141 | 1016 | CCUCACCUCCUCUAAGGUUmUmU | 3047 | AACCUUAGAGGAGGUGAGGmUmU |
| 1142 | 1017 | CUCACCUCCUCUAAGGUUGmUmU | 3048 | CAACCUUAGAGGAGGUGAGmUmU |
| 1143 | 1018 | UCACCUCCUCUAAGGUUGGmUmU | 3049 | CCAACCUUAGAGGAGGUGAmUmU |
| 1144 | 1019 | CACCUCCUCUAAGGUUGGGmUmU | 3050 | CCCAACCUUAGAGGAGGUGmUmU |
| 1145 | 1020 | ACCUCCUCUAAGGUUGGGCmUmU | 3051 | GCCCAACCUUAGAGGAGGUmUmU |
| 1146 | 1021 | CCUCCUCUAAGGUUGGGCAmUmU | 3052 | UGCCCAACCUUAGAGGAGGmUmU |
| 1147 | 1022 | CUCCUCUAAGGUUGGGCAGmUmU | 3053 | CUGCCCAACCUUAGAGGAGmUmU |
| 1148 | 1023 | UCCUCUAAGGUUGGGCAGGmUmU | 3054 | CCUGCCCAACCUUAGAGGAmUmU |
| 1149 | 1024 | CCUCUAAGGUUGGGCAGGGmUmU | 3055 | CCCUGCCCAACCUUAGAGGmUmU |
| 1150 | 1025 | CUCUAAGGUUGGGCAGGGUmUmU | 3056 | ACCCUGCCCAACCUUAGAGmUmU |
| 1151 | 1026 | UCUAAGGUUGGGCAGGGUGmUmU | 3057 | CACCCUGCCCAACCUUAGAmUmU |
| 1152 | 1027 | CUAAGGUUGGGCAGGGUGAmUmU | 3058 | UCACCCUGCCCAACCUUAGmUmU |
| 1153 | 1028 | UAAGGUUGGGCAGGGUGACmUmU | 3059 | GUCACCCUGCCCAACCUUAmUmU |
| 1154 | 1029 | AAGGUUGGGCAGGGUGACCmUmU | 3060 | GGUCACCCUGCCCAACCUUmUmU |
| 1155 | 1030 | AGGUUGGGCAGGGUGACCCmUmU | 3061 | GGGUCACCCUGCCCAACCUmUmU |
| 1156 | 1031 | GGUUGGGCAGGGUGACCCUmUmU | 3062 | AGGGUCACCCUGCCCAACCmUmU |
| 1157 | 1032 | GUUGGGCAGGGUGACCCUGmUmU | 3063 | CAGGGUCACCCUGCCCAACmUmU |
| 1158 | 1033 | UUGGGCAGGGUGACCCUGAmUmU | 3064 | UCAGGGUCACCCUGCCCAAmUmU |
| 1159 | 1034 | UGGGCAGGGUGACCCUGAAmUmU | 3065 | UUCAGGGUCACCCUGCCCAmUmU |
| 1160 | 1035 | GGGCAGGGUGACCCUGAAGmUmU | 3066 | CUUCAGGGUCACCCUGCCCmUmU |
| 1161 | 1036 | GGCAGGGUGACCCUGAAGUmUmU | 3067 | ACUUCAGGGUCACCCUGCCmUmU |
| 1162 | 1037 | GCAGGGUGACCCUGAAGUGmUmU | 3068 | CACUUCAGGGUCACCCUGCmUmU |
| 1163 | 1038 | CAGGGUGACCCUGAAGUGAmUmU | 3069 | UCACUUCAGGGUCACCCUGmUmU |
| 1164 | 1039 | AGGGUGACCCUGAAGUGAGmUmU | 3070 | CUCACUUCAGGGUCACCCUmUmU |
| 1165 | 1040 | GGGUGACCCUGAAGUGAGCmUmU | 3071 | GCUCACUUCAGGGUCACCCmUmU |
| 1166 | 1041 | GGUGACCCUGAAGUGAGCAmUmU | 3072 | UGCUCACUUCAGGGUCACCmUmU |
| 1167 | 1042 | GUGACCCUGAAGUGAGCACmUmU | 3073 | GUGCUCACUUCAGGGUCACmUmU |
| 1168 | 1043 | UGACCCUGAAGUGAGCACAmUmU | 3074 | UGUGCUCACUUCAGGGUCAmUmU |
| 1169 | 1044 | GACCCUGAAGUGAGCACAGmUmU | 3075 | CUGUGCUCACUUCAGGGUCmUmU |
| 1170 | 1045 | ACCCUGAAGUGAGCACAGCmUmU | 3076 | GCUGUGCUCACUUCAGGGUmUmU |
| 1171 | 1046 | CCCUGAAGUGAGCACAGCCmUmU | 3077 | GGCUGUGCUCACUUCAGGGmUmU |
| 1172 | 1047 | CCUGAAGUGAGCACAGCCUmUmU | 3078 | AGGCUGUGCUCACUUCAGGmUmU |
| 1173 | 1048 | CUGAAGUGAGCACAGCCUAmUmU | 3079 | UAGGCUGUGCUCACUUCAGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1174 | 1049 | UGAAGUGAGCACAGCCUAGmUmU | 3080 | CUAGGCUGUGCUCACUUCAmUmU |
| 1175 | 1050 | GAAGUGAGCACAGCCUAGGmUmU | 3081 | CCUAGGCUGUGCUCACUUCmUmU |
| 1176 | 1051 | AAGUGAGCACAGCCUAGGGmUmU | 3082 | CCCUAGGCUGUGCUCACUUmUmU |
| 1177 | 1052 | AGUGAGCACAGCCUAGGGCmUmU | 3083 | GCCCUAGGCUGUGCUCACUmUmU |
| 1178 | 1053 | GUGAGCACAGCCUAGGGCUmUmU | 3084 | AGCCCUAGGCUGUGCUCACmUmU |
| 1179 | 1054 | UGAGCACAGCCUAGGGCUGmUmU | 3085 | CAGCCCUAGGCUGUGCUCAmUmU |
| 1180 | 1055 | GAGCACAGCCUAGGGCUGAmUmU | 3086 | UCAGCCCUAGGCUGUGCUCmUmU |
| 1181 | 1056 | AGCACAGCCUAGGGCUGAGmUmU | 3087 | CUCAGCCCUAGGCUGUGCUmUmU |
| 1182 | 1057 | GCACAGCCUAGGGCUGAGCmUmU | 3088 | GCUCAGCCCUAGGCUGUGCmUmU |
| 1183 | 1058 | CACAGCCUAGGGCUGAGCUmUmU | 3089 | AGCUCAGCCCUAGGCUGUGmUmU |
| 1184 | 1059 | ACAGCCUAGGGCUGAGCUGmUmU | 3090 | CAGCUCAGCCCUAGGCUGUmUmU |
| 1185 | 1060 | CAGCCUAGGGCUGAGCUGGmUmU | 3091 | CCAGCUCAGCCCUAGGCUGmUmU |
| 1186 | 1061 | AGCCUAGGGCUGAGCUGGGmUmU | 3092 | CCCAGCUCAGCCCUAGGCUmUmU |
| 1187 | 1062 | GCCUAGGGCUGAGCUGGGGmUmU | 3093 | CCCCAGCUCAGCCCUAGGCmUmU |
| 1188 | 1063 | CCUAGGGCUGAGCUGGGGAmUmU | 3094 | UCCCCAGCUCAGCCCUAGGmUmU |
| 1189 | 1064 | CUAGGGCUGAGCUGGGGACmUmU | 3095 | GUCCCCAGCUCAGCCCUAGmUmU |
| 1190 | 1065 | UAGGGCUGAGCUGGGGACCmUmU | 3096 | GGUCCCCAGCUCAGCCCUAmUmU |
| 1191 | 1066 | AGGGCUGAGCUGGGGACCUmUmU | 3097 | AGGUCCCCAGCUCAGCCCUmUmU |
| 1192 | 1067 | GGGCUGAGCUGGGGACCUGmUmU | 3098 | CAGGUCCCCAGCUCAGCCCmUmU |
| 1193 | 1068 | GGCUGAGCUGGGGACCUGGmUmU | 3099 | CCAGGUCCCCAGCUCAGCCmUmU |
| 1194 | 1069 | GCUGAGCUGGGGACCUGGUmUmU | 3100 | ACCAGGUCCCCAGCUCAGCmUmU |
| 1195 | 1070 | CUGAGCUGGGGACCUGGUAmUmU | 3101 | UACCAGGUCCCCAGCUCAGmUmU |
| 1196 | 1071 | UGAGCUGGGGACCUGGUACmUmU | 3102 | GUACCAGGUCCCCAGCUCAmUmU |
| 1197 | 1072 | GAGCUGGGGACCUGGUACCmUmU | 3103 | GGUACCAGGUCCCCAGCUCmUmU |
| 1198 | 1073 | AGCUGGGGACCUGGUACCCmUmU | 3104 | GGGUACCAGGUCCCCAGCUmUmU |
| 1199 | 1074 | GCUGGGGACCUGGUACCCUmUmU | 3105 | AGGGUACCAGGUCCCCAGCmUmU |
| 1200 | 1075 | CUGGGGACCUGGUACCCUCmUmU | 3106 | GAGGGUACCAGGUCCCCAGmUmU |
| 1201 | 1076 | UGGGGACCUGGUACCCUCCmUmU | 3107 | GGAGGGUACCAGGUCCCCAmUmU |
| 1202 | 1077 | GGGGACCUGGUACCCUCCUmUmU | 3108 | AGGAGGGUACCAGGUCCCCmUmU |
| 1203 | 1078 | GGGACCUGGUACCCUCCUGmUmU | 3109 | CAGGAGGGUACCAGGUCCCmUmU |
| 1204 | 1079 | GGACCUGGUACCCUCCUGGmUmU | 3110 | CCAGGAGGGUACCAGGUCCmUmU |
| 1205 | 1080 | GACCUGGUACCCUCCUGGCmUmU | 3111 | GCCAGGAGGGUACCAGGUCmUmU |
| 1206 | 1081 | ACCUGGUACCCUCCUGGCUmUmU | 3112 | AGCCAGGAGGGUACCAGGUmUmU |
| 1207 | 1082 | CCUGGUACCCUCCUGGCUCmUmU | 3113 | GAGCCAGGAGGGUACCAGGmUmU |
| 1208 | 1083 | CUGGUACCCUCCUGGCUCUmUmU | 3114 | AGAGCCAGGAGGGUACCAGmUmU |
| 1209 | 1084 | UGGUACCCUCCUGGCUCUUmUmU | 3115 | AAGAGCCAGGAGGGUACCAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1210 | 1085 | GGUACCCUCCUGGCUCUUGmUmU | 3116 | CAAGAGCCAGGAGGGUACCmUmU |
| 1211 | 1086 | GUACCCUCCUGGCUCUUGAmUmU | 3117 | UCAAGAGCCAGGAGGGUACmUmU |
| 1212 | 1087 | UACCCUCCUGGCUCUUGAUmUmU | 3118 | AUCAAGAGCCAGGAGGGUAmUmU |
| 1213 | 1088 | ACCCUCCUGGCUCUUGAUAmUmU | 3119 | UAUCAAGAGCCAGGAGGGUmUmU |
| 1214 | 1089 | CCCUCCUGGCUCUUGAUACmUmU | 3120 | GUAUCAAGAGCCAGGAGGGmUmU |
| 1215 | 1090 | CCUCCUGGCUCUUGAUACCmUmU | 3121 | GGUAUCAAGAGCCAGGAGGmUmU |
| 1216 | 1091 | CUCCUGGCUCUUGAUACCCmUmU | 3122 | GGGUAUCAAGAGCCAGGAGmUmU |
| 1217 | 1092 | UCCUGGCUCUUGAUACCCCmUmU | 3123 | GGGGUAUCAAGAGCCAGGAmUmU |
| 1218 | 1093 | CCUGGCUCUUGAUACCCCCmUmU | 3124 | GGGGGUAUCAAGAGCCAGGmUmU |
| 1219 | 1094 | CUGGCUCUUGAUACCCCCCmUmU | 3125 | GGGGGGUAUCAAGAGCCAGmUmU |
| 1220 | 1095 | UGGCUCUUGAUACCCCCCUmUmU | 3126 | AGGGGGGUAUCAAGAGCCAmUmU |
| 1221 | 1096 | GGCUCUUGAUACCCCCCUCmUmU | 3127 | GAGGGGGGUAUCAAGAGCCmUmU |
| 1222 | 1097 | GCUCUUGAUACCCCCCUCUmUmU | 3128 | AGAGGGGGGUAUCAAGAGCmUmU |
| 1223 | 1098 | CUCUUGAUACCCCCCUCUGmUmU | 3129 | CAGAGGGGGGUAUCAAGAGmUmU |
| 1224 | 1099 | UCUUGAUACCCCCCUCUGUmUmU | 3130 | ACAGAGGGGGGUAUCAAGAmUmU |
| 1225 | 1100 | CUUGAUACCCCCCUCUGUCmUmU | 3131 | GACAGAGGGGGGUAUCAAGmUmU |
| 1226 | 1101 | UUGAUACCCCCCUCUGUCUmUmU | 3132 | AGACAGAGGGGGGUAUCAAmUmU |
| 1227 | 1102 | UGAUACCCCCCUCUGUCUUmUmU | 3133 | AAGACAGAGGGGGGUAUCAmUmU |
| 1228 | 1103 | GAUACCCCCCUCUGUCUUGmUmU | 3134 | CAAGACAGAGGGGGGUAUCmUmU |
| 1229 | 1104 | AUACCCCCCUCUGUCUUGUmUmU | 3135 | ACAAGACAGAGGGGGGUAUmUmU |
| 1230 | 1105 | UACCCCCCUCUGUCUUGUGmUmU | 3136 | CACAAGACAGAGGGGGGUAmUmU |
| 1231 | 1106 | ACCCCCCUCUGUCUUGUGAmUmU | 3137 | UCACAAGACAGAGGGGGGUmUmU |
| 1232 | 1107 | CCCCCCUCUGUCUUGUGAAmUmU | 3138 | UUCACAAGACAGAGGGGGGmUmU |
| 1233 | 1108 | CCCCCUCUGUCUUGUGAAGmUmU | 3139 | CUUCACAAGACAGAGGGGGmUmU |
| 1234 | 1109 | CCCCUCUGUCUUGUGAAGGmUmU | 3140 | CCUUCACAAGACAGAGGGGmUmU |
| 1235 | 1110 | CCCUCUGUCUUGUGAAGGCmUmU | 3141 | GCCUUCACAAGACAGAGGGmUmU |
| 1236 | 1111 | CCUCUGUCUUGUGAAGGCAmUmU | 3142 | UGCCUUCACAAGACAGAGGmUmU |
| 1237 | 1112 | CUCUGUCUUGUGAAGGCAGmUmU | 3143 | CUGCCUUCACAAGACAGAGmUmU |
| 1238 | 1113 | UCUGUCUUGUGAAGGCAGGmUmU | 3144 | CCUGCCUUCACAAGACAGAmUmU |
| 1239 | 1114 | CUGUCUUGUGAAGGCAGGGmUmU | 3145 | CCCUGCCUUCACAAGACAGmUmU |
| 1240 | 1115 | UGUCUUGUGAAGGCAGGGGmUmU | 3146 | CCCCUGCCUUCACAAGACAmUmU |
| 1241 | 1116 | GUCUUGUGAAGGCAGGGGGmUmU | 3147 | CCCCCUGCCUUCACAAGACmUmU |
| 1242 | 1117 | UCUUGUGAAGGCAGGGGGAmUmU | 3148 | UCCCCCUGCCUUCACAAGAmUmU |
| 1243 | 1118 | CUUGUGAAGGCAGGGGGAAmUmU | 3149 | UUCCCCCUGCCUUCACAAGmUmU |
| 1244 | 1119 | UUGUGAAGGCAGGGGGAAGmUmU | 3150 | CUUCCCCCUGCCUUCACAAmUmU |
| 1245 | 1120 | UGUGAAGGCAGGGGGAAGGmUmU | 3151 | CCUUCCCCCUGCCUUCACAmUmU |
| 1246 | 1121 | GUGAAGGCAGGGGGAAGGUmUmU | 3152 | ACCUUCCCCCUGCCUUCACmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1247 | 1122 | UGAAGGCAGGGGGAAGGUGmUmU | 3153 | CACCUUCCCCCUGCCUUCAmUmU |
| 1248 | 1123 | GAAGGCAGGGGGAAGGUGGmUmU | 3154 | CCACCUUCCCCCUGCCUUCmUmU |
| 1249 | 1124 | AAGGCAGGGGGAAGGUGGGmUmU | 3155 | CCCACCUUCCCCCUGCCUUmUmU |
| 1250 | 1125 | AGGCAGGGGGAAGGUGGGGmUmU | 3156 | CCCCACCUUCCCCCUGCCmUmU |
| 1251 | 1126 | GGCAGGGGGAAGGUGGGGUmUmU | 3157 | ACCCCACCUUCCCCCUGCmUmU |
| 1252 | 1127 | GCAGGGGGAAGGUGGGGUCmUmU | 3158 | GACCCCACCUUCCCCCUGmUmU |
| 1253 | 1128 | CAGGGGGAAGGUGGGGUCCmUmU | 3159 | GGACCCCACCUUCCCCCUGmUmU |
| 1254 | 1129 | AGGGGGAAGGUGGGGUCCUmUmU | 3160 | AGGACCCCACCUUCCCCCUmUmU |
| 1255 | 1130 | GGGGGAAGGUGGGGUCCUGmUmU | 3161 | CAGGACCCCACCUUCCCCCmUmU |
| 1256 | 1131 | GGGGAAGGUGGGGUCCUGGmUmU | 3162 | CCAGGACCCCACCUUCCCCmUmU |
| 1257 | 1132 | GGGAAGGUGGGGUCCUGGAmUmU | 3163 | UCCAGGACCCCACCUUCCCmUmU |
| 1258 | 1133 | GGAAGGUGGGGUCCUGGAGmUmU | 3164 | CUCCAGGACCCCACCUUCCmUmU |
| 1259 | 1134 | GAAGGUGGGGUCCUGGAGCmUmU | 3165 | GCUCCAGGACCCCACCUUCmUmU |
| 1260 | 1135 | AAGGUGGGGUCCUGGAGCAmUmU | 3166 | UGCUCCAGGACCCCACCUUmUmU |
| 1261 | 1136 | AGGUGGGGUCCUGGAGCAGmUmU | 3167 | CUGCUCCAGGACCCCACCUmUmU |
| 1262 | 1137 | GGUGGGGUCCUGGAGCAGAmUmU | 3168 | UCUGCUCCAGGACCCCACCmUmU |
| 1263 | 1138 | GUGGGGUCCUGGAGCAGACmUmU | 3169 | GUCUGCUCCAGGACCCCACmUmU |
| 1264 | 1139 | UGGGGUCCUGGAGCAGACCmUmU | 3170 | GGUCUGCUCCAGGACCCCAmUmU |
| 1265 | 1140 | GGGGUCCUGGAGCAGACCAmUmU | 3171 | UGGUCUGCUCCAGGACCCCmUmU |
| 1266 | 1141 | GGGUCCUGGAGCAGACCACmUmU | 3172 | GUGGUCUGCUCCAGGACCCmUmU |
| 1267 | 1142 | GGUCCUGGAGCAGACCACCmUmU | 3173 | GGUGGUCUGCUCCAGGACCmUmU |
| 1268 | 1143 | GUCCUGGAGCAGACCACCCmUmU | 3174 | GGGUGGUCUGCUCCAGGACmUmU |
| 1269 | 1144 | UCCUGGAGCAGACCACCCCmUmU | 3175 | GGGGUGGUCUGCUCCAGGAmUmU |
| 1270 | 1145 | CCUGGAGCAGACCACCCCGmUmU | 3176 | CGGGGUGGUCUGCUCCAGGmUmU |
| 1271 | 1146 | CUGGAGCAGACCACCCCGCmUmU | 3177 | GCGGGGUGGUCUGCUCCAGmUmU |
| 1272 | 1147 | UGGAGCAGACCACCCCGCCmUmU | 3178 | GGCGGGGUGGUCUGCUCCAmUmU |
| 1273 | 1148 | GGAGCAGACCACCCCGCCUmUmU | 3179 | AGGCGGGGUGGUCUGCUCCmUmU |
| 1274 | 1149 | GAGCAGACCACCCCGCCUGmUmU | 3180 | CAGGCGGGGUGGUCUGCUCmUmU |
| 1275 | 1150 | AGCAGACCACCCCGCCUGCmUmU | 3181 | GCAGGCGGGGUGGUCUGCUmUmU |
| 1276 | 1151 | GCAGACCACCCCGCCUGCCmUmU | 3182 | GGCAGGCGGGGUGGUCUGCmUmU |
| 1277 | 1152 | CAGACCACCCCGCCUGCCCmUmU | 3183 | GGGCAGGCGGGGUGGUCUGmUmU |
| 1278 | 1153 | AGACCACCCCGCCUGCCCUmUmU | 3184 | AGGGCAGGCGGGGUGGUCUmUmU |
| 1279 | 1154 | GACCACCCCGCCUGCCCUCmUmU | 3185 | GAGGGCAGGCGGGGUGGUCmUmU |
| 1280 | 1155 | ACCACCCCGCCUGCCCUCAmUmU | 3186 | UGAGGGCAGGCGGGGUGGUmUmU |
| 1281 | 1156 | CCACCCCGCCUGCCCUCAUmUmU | 3187 | AUGAGGGCAGGCGGGGUGGmUmU |
| 1282 | 1157 | CACCCCGCCUGCCCUCAUGmUmU | 3188 | CAUGAGGGCAGGCGGGGUGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1283 | 1158 | ACCCCGCCUGCCCUCAUGGCmUmU | 3189 | CCAUGAGGGCAGGCGGGGUmUmU |
| 1284 | 1159 | CCCCGCCUGCCCUCAUGGCmUmU | 3190 | GCCAUGAGGGCAGGCGGGGmUmU |
| 1285 | 1160 | CCCGCCUGCCCUCAUGGCCmUmU | 3191 | GGCCAUGAGGGCAGGCGGGmUmU |
| 1286 | 1161 | CCGCCUGCCCUCAUGGCCCmUmU | 3192 | GGGCCAUGAGGGCAGGCGGmUmU |
| 1287 | 1162 | CGCCUGCCCUCAUGGCCCCmUmU | 3193 | GGGGCCAUGAGGGCAGGCGmUmU |
| 1288 | 1163 | GCCUGCCCUCAUGGCCCCUmUmU | 3194 | AGGGGCCAUGAGGGCAGGCmUmU |
| 1289 | 1164 | CCUGCCCUCAUGGCCCCUCmUmU | 3195 | GAGGGGCCAUGAGGGCAGGmUmU |
| 1290 | 1165 | CUGCCCUCAUGGCCCCUCUmUmU | 3196 | AGAGGGGCCAUGAGGGCAGmUmU |
| 1291 | 1166 | UGCCCUCAUGGCCCCUCUGmUmU | 3197 | CAGAGGGGCCAUGAGGGCAmUmU |
| 1292 | 1167 | GCCCUCAUGGCCCCUCUGAmUmU | 3198 | UCAGAGGGGCCAUGAGGGCmUmU |
| 1293 | 1168 | CCCUCAUGGCCCCUCUGACmUmU | 3199 | GUCAGAGGGGCCAUGAGGGmUmU |
| 1294 | 1169 | CCUCAUGGCCCCUCUGACCmUmU | 3200 | GGUCAGAGGGGCCAUGAGGmUmU |
| 1295 | 1170 | CUCAUGGCCCCUCUGACCUmUmU | 3201 | AGGUCAGAGGGGCCAUGAGmUmU |
| 1296 | 1171 | UCAUGGCCCCUCUGACCUGmUmU | 3202 | CAGGUCAGAGGGGCCAUGAmUmU |
| 1297 | 1172 | CAUGGCCCCUCUGACCUGCmUmU | 3203 | GCAGGUCAGAGGGGCCAUGmUmU |
| 1298 | 1173 | AUGGCCCCUCUGACCUGCAmUmU | 3204 | UGCAGGUCAGAGGGGCCAUmUmU |
| 1299 | 1174 | UGGCCCCUCUGACCUGCACmUmU | 3205 | GUGCAGGUCAGAGGGGCCAmUmU |
| 1300 | 1175 | GGCCCCUCUGACCUGCACUmUmU | 3206 | AGUGCAGGUCAGAGGGGCCmUmU |
| 1301 | 1176 | GCCCCUCUGACCUGCACUGmUmU | 3207 | CAGUGCAGGUCAGAGGGGCmUmU |
| 1302 | 1177 | CCCCUCUGACCUGCACUGGmUmU | 3208 | CCAGUGCAGGUCAGAGGGGmUmU |
| 1303 | 1178 | CCCUCUGACCUGCACUGGGmUmU | 3209 | CCCAGUGCAGGUCAGAGGGmUmU |
| 1304 | 1179 | CCUCUGACCUGCACUGGGGmUmU | 3210 | CCCCAGUGCAGGUCAGAGGmUmU |
| 1305 | 1180 | CUCUGACCUGCACUGGGGAmUmU | 3211 | UCCCCAGUGCAGGUCAGAGmUmU |
| 1306 | 1181 | UCUGACCUGCACUGGGGAGmUmU | 3212 | CUCCCCAGUGCAGGUCAGAmUmU |
| 1307 | 1182 | CUGACCUGCACUGGGGAGCmUmU | 3213 | GCUCCCCAGUGCAGGUCAGmUmU |
| 1308 | 1183 | UGACCUGCACUGGGGAGCCmUmU | 3214 | GGCUCCCCAGUGCAGGUCAmUmU |
| 1309 | 1184 | GACCUGCACUGGGGAGCCCmUmU | 3215 | GGGCUCCCCAGUGCAGGUCmUmU |
| 1310 | 1185 | ACCUGCACUGGGGAGCCCGmUmU | 3216 | CGGGCUCCCCAGUGCAGGUmUmU |
| 1311 | 1186 | CCUGCACUGGGGAGCCCGUmUmU | 3217 | ACGGGCUCCCCAGUGCAGGmUmU |
| 1312 | 1187 | CUGCACUGGGGAGCCCGUCmUmU | 3218 | GACGGGCUCCCCAGUGCAGmUmU |
| 1313 | 1188 | UGCACUGGGGAGCCCGUCUmUmU | 3219 | AGACGGGCUCCCCAGUGCAmUmU |
| 1314 | 1189 | GCACUGGGGAGCCCGUCUCmUmU | 3220 | GAGACGGGCUCCCCAGUGCmUmU |
| 1315 | 1190 | CACUGGGGAGCCCGUCUCAmUmU | 3221 | UGAGACGGGCUCCCCAGUGmUmU |
| 1316 | 1191 | ACUGGGGAGCCCGUCUCAGmUmU | 3222 | CUGAGACGGGCUCCCCAGUmUmU |
| 1317 | 1192 | CUGGGGAGCCCGUCUCAGUmUmU | 3223 | ACUGAGACGGGCUCCCCAGmUmU |
| 1318 | 1193 | UGGGGAGCCCGUCUCAGUGmUmU | 3224 | CACUGAGACGGGCUCCCCAmUmU |
| 1319 | 1194 | GGGGAGCCCGUCUCAGUGUmUmU | 3225 | ACACUGAGACGGGCUCCCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1320 | 1195 | GGGAGCCCGUCUCAGUGUUmUmU | 3226 | AACACUGAGACGGGCUCCCmUmU |
| 1321 | 1196 | GGAGCCCGUCUCAGUGUUGmUmU | 3227 | CAACACUGAGACGGGCUCCmUmU |
| 1322 | 1197 | GAGCCCGUCUCAGUGUUGAmUmU | 3228 | UCAACACUGAGACGGGCUCmUmU |
| 1323 | 1198 | AGCCCGUCUCAGUGUUGAGmUmU | 3229 | CUCAACACUGAGACGGGCUmUmU |
| 1324 | 1199 | GCCCGUCUCAGUGUUGAGCmUmU | 3230 | GCUCAACACUGAGACGGGCmUmU |
| 1325 | 1200 | CCCGUCUCAGUGUUGAGCCmUmU | 3231 | GGCUCAACACUGAGACGGGmUmU |
| 1326 | 1201 | CCGUCUCAGUGUUGAGCCUmUmU | 3232 | AGGCUCAACACUGAGACGGmUmU |
| 1327 | 1202 | CGUCUCAGUGUUGAGCCUUmUmU | 3233 | AAGGCUCAACACUGAGACGmUmU |
| 1328 | 1203 | GUCUCAGUGUUGAGCCUUUmUmU | 3234 | AAAGGCUCAACACUGAGACmUmU |
| 1329 | 1204 | UCUCAGUGUUGAGCCUUUUmUmU | 3235 | AAAAGGCUCAACACUGAGAmUmU |
| 1330 | 1205 | CUCAGUGUUGAGCCUUUUCmUmU | 3236 | GAAAAGGCUCAACACUGAGmUmU |
| 1331 | 1206 | UCAGUGUUGAGCCUUUUCCmUmU | 3237 | GGAAAAGGCUCAACACUGAmUmU |
| 1332 | 1207 | CAGUGUUGAGCCUUUUCCCmUmU | 3238 | GGGAAAAGGCUCAACACUGmUmU |
| 1333 | 1208 | AGUGUUGAGCCUUUUCCCUmUmU | 3239 | AGGGAAAAGGCUCAACACUmUmU |
| 1334 | 1209 | GUGUUGAGCCUUUUCCCUCmUmU | 3240 | GAGGGAAAAGGCUCAACACmUmU |
| 1335 | 1210 | UGUUGAGCCUUUUCCCUCUmUmU | 3241 | AGAGGGAAAAGGCUCAACAmUmU |
| 1336 | 1211 | GUUGAGCCUUUUCCCUCUUmUmU | 3242 | AAGAGGGAAAAGGCUCAACmUmU |
| 1337 | 1212 | UUGAGCCUUUUCCCUCUUUmUmU | 3243 | AAAGAGGGAAAAGGCUCAAmUmU |
| 1338 | 1213 | UGAGCCUUUUCCCUCUUUGmUmU | 3244 | CAAAGAGGGAAAAGGCUCAmUmU |
| 1339 | 1214 | GAGCCUUUUCCCUCUUUGGmUmU | 3245 | CCAAAGAGGGAAAAGGCUCmUmU |
| 1340 | 1215 | AGCCUUUUCCCUCUUUGGCmUmU | 3246 | GCCAAAGAGGGAAAAGGCUmUmU |
| 1341 | 1216 | GCCUUUUCCCUCUUUGGCUmUmU | 3247 | AGCCAAAGAGGGAAAAGGCmUmU |
| 1342 | 1217 | CCUUUUCCCUCUUUGGCUCmUmU | 3248 | GAGCCAAAGAGGGAAAAGGmUmU |
| 1343 | 1218 | CUUUUCCCUCUUUGGCUCCmUmU | 3249 | GGAGCCAAAGAGGGAAAAGmUmU |
| 1344 | 1219 | UUUUCCCUCUUUGGCUCCCmUmU | 3250 | GGGAGCCAAAGAGGGAAAAmUmU |
| 1345 | 1220 | UUUCCCUCUUUGGCUCCCCmUmU | 3251 | GGGGAGCCAAAGAGGGAAAmUmU |
| 1346 | 1221 | UUCCCUCUUUGGCUCCCCUmUmU | 3252 | AGGGGAGCCAAAGAGGGAAmUmU |
| 1347 | 1222 | UCCCUCUUUGGCUCCCCUGmUmU | 3253 | CAGGGGAGCCAAAGAGGGAmUmU |
| 1348 | 1223 | CCCUCUUUGGCUCCCCUGUmUmU | 3254 | ACAGGGGAGCCAAAGAGGGmUmU |
| 1349 | 1224 | CCUCUUUGGCUCCCCUGUAmUmU | 3255 | UACAGGGGAGCCAAAGAGGmUmU |
| 1350 | 1225 | CUCUUUGGCUCCCCUGUACmUmU | 3256 | GUACAGGGGAGCCAAAGAGmUmU |
| 1351 | 1226 | UCUUUGGCUCCCCUGUACCmUmU | 3257 | GGUACAGGGGAGCCAAAGAmUmU |
| 1352 | 1227 | CUUUGGCUCCCCUGUACCUmUmU | 3258 | AGGUACAGGGGAGCCAAAGmUmU |
| 1353 | 1228 | UUUGGCUCCCCUGUACCUUmUmU | 3259 | AAGGUACAGGGGAGCCAAAmUmU |
| 1354 | 1229 | UUGGCUCCCCUGUACCUUUmUmU | 3260 | AAAGGUACAGGGGAGCCAAmUmU |
| 1355 | 1230 | UGGCUCCCCUGUACCUUUUmUmU | 3261 | AAAAGGUACAGGGGAGCCAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1356 | 1231 | GGCUCCCCUGUACCUUUUGmUmU | 3262 | CAAAAGGUACAGGGGAGCCmUmU |
| 1357 | 1232 | GCUCCCCUGUACCUUUUGAmUmU | 3263 | UCAAAAGGUACAGGGGAGCmUmU |
| 1358 | 1233 | CUCCCCUGUACCUUUUGAGmUmU | 3264 | CUCAAAAGGUACAGGGGAGmUmU |
| 1359 | 1234 | UCCCCUGUACCUUUUGAGGmUmU | 3265 | CCUCAAAAGGUACAGGGGAmUmU |
| 1360 | 1235 | CCCCUGUACCUUUUGAGGAmUmU | 3266 | UCCUCAAAAGGUACAGGGGmUmU |
| 1361 | 1236 | CCCUGUACCUUUUGAGGAGmUmU | 3267 | CUCCUCAAAAGGUACAGGGmUmU |
| 1362 | 1237 | CCUGUACCUUUUGAGGAGCmUmU | 3268 | GCUCCUCAAAAGGUACAGGmUmU |
| 1363 | 1238 | CUGUACCUUUUGAGGAGCCmUmU | 3269 | GGCUCCUCAAAAGGUACAGmUmU |
| 1364 | 1239 | UGUACCUUUUGAGGAGCCCmUmU | 3270 | GGGCUCCUCAAAAGGUACAmUmU |
| 1365 | 1240 | GUACCUUUUGAGGAGCCCCmUmU | 3271 | GGGGCUCCUCAAAAGGUACmUmU |
| 1366 | 1241 | UACCUUUUGAGGAGCCCCAmUmU | 3272 | UGGGGCUCCUCAAAAGGUAmUmU |
| 1367 | 1242 | ACCUUUUGAGGAGCCCCAGmUmU | 3273 | CUGGGGCUCCUCAAAAGGUmUmU |
| 1368 | 1243 | CCUUUUGAGGAGCCCCAGCmUmU | 3274 | GCUGGGGCUCCUCAAAAGGmUmU |
| 1369 | 1244 | CUUUUGAGGAGCCCCAGCUmUmU | 3275 | AGCUGGGGCUCCUCAAAAGmUmU |
| 1370 | 1245 | UUUUGAGGAGCCCCAGCUAmUmU | 3276 | UAGCUGGGGCUCCUCAAAAmUmU |
| 1371 | 1246 | UUUGAGGAGCCCCAGCUACmUmU | 3277 | GUAGCUGGGGCUCCUCAAAmUmU |
| 1372 | 1247 | UUGAGGAGCCCCAGCUACCmUmU | 3278 | GGUAGCUGGGGCUCCUCAAmUmU |
| 1373 | 1248 | UGAGGAGCCCCAGCUACCCmUmU | 3279 | GGGUAGCUGGGGCUCCUCAmUmU |
| 1374 | 1249 | GAGGAGCCCCAGCUACCCUmUmU | 3280 | AGGGUAGCUGGGGCUCCUCmUmU |
| 1375 | 1250 | AGGAGCCCCAGCUACCCUUmUmU | 3281 | AAGGGUAGCUGGGGCUCCUmUmU |
| 1376 | 1251 | GGAGCCCCAGCUACCCUUCmUmU | 3282 | GAAGGGUAGCUGGGGCUCCmUmU |
| 1377 | 1252 | GAGCCCCAGCUACCCUUCUmUmU | 3283 | AGAAGGGUAGCUGGGGCUCmUmU |
| 1378 | 1253 | AGCCCCAGCUACCCUUCUUmUmU | 3284 | AAGAAGGGUAGCUGGGGCUmUmU |
| 1379 | 1254 | GCCCCAGCUACCCUUCUUCmUmU | 3285 | GAAGAAGGGUAGCUGGGGCmUmU |
| 1380 | 1255 | CCCCAGCUACCCUUCUUCUmUmU | 3286 | AGAAGAAGGGUAGCUGGGGmUmU |
| 1381 | 1256 | CCCAGCUACCCUUCUUCUCmUmU | 3287 | GAGAAGAAGGGUAGCUGGGmUmU |
| 1382 | 1257 | CCAGCUACCCUUCUUCUCCmUmU | 3288 | GGAGAAGAAGGGUAGCUGGmUmU |
| 1383 | 1258 | CAGCUACCCUUCUUCUCCAmUmU | 3289 | UGGAGAAGAAGGGUAGCUGmUmU |
| 1384 | 1259 | AGCUACCCUUCUUCUCCAGmUmU | 3290 | CUGGAGAAGAAGGGUAGCUmUmU |
| 1385 | 1260 | GCUACCCUUCUUCUCCAGCmUmU | 3291 | GCUGGAGAAGAAGGGUAGCmUmU |
| 1386 | 1261 | CUACCCUUCUUCUCCAGCUmUmU | 3292 | AGCUGGAGAAGAAGGGUAGmUmU |
| 1387 | 1262 | UACCCUUCUUCUCCAGCUGmUmU | 3293 | CAGCUGGAGAAGAAGGGUAmUmU |
| 1388 | 1263 | ACCCUUCUUCUCCAGCUGGmUmU | 3294 | CCAGCUGGAGAAGAAGGGUmUmU |
| 1389 | 1264 | CCCUUCUUCUCCAGCUGGGmUmU | 3295 | CCCAGCUGGAGAAGAAGGGmUmU |
| 1390 | 1265 | CCUUCUUCUCCAGCUGGGCmUmU | 3296 | GCCCAGCUGGAGAAGAAGGmUmU |
| 1391 | 1266 | CUUCUUCUCCAGCUGGGCUmUmU | 3297 | AGCCCAGCUGGAGAAGAAGmUmU |
| 1392 | 1267 | UUCUUCUCCAGCUGGGCUCmUmU | 3298 | GAGCCCAGCUGGAGAAGAAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1393 | 1268 | UCUUCUCCAGCUGGGCUCUmUmU | 3299 | AGAGCCCAGCUGGAGAAGAmUmU |
| 1394 | 1269 | CUUCUCCAGCUGGGCUCUGmUmU | 3300 | CAGAGCCCAGCUGGAGAAGmUmU |
| 1395 | 1270 | UUCUCCAGCUGGGCUCUGCmUmU | 3301 | GCAGAGCCCAGCUGGAGAAmUmU |
| 1396 | 1271 | UCUCCAGCUGGGCUCUGCAmUmU | 3302 | UGCAGAGCCCAGCUGGAGAmUmU |
| 1397 | 1272 | CUCCAGCUGGGCUCUGCAAmUmU | 3303 | UUGCAGAGCCCAGCUGGAGmUmU |
| 1398 | 1273 | UCCAGCUGGGCUCUGCAAUmUmU | 3304 | AUUGCAGAGCCCAGCUGGAmUmU |
| 1399 | 1274 | CCAGCUGGGCUCUGCAAUUmUmU | 3305 | AAUUGCAGAGCCCAGCUGGmUmU |
| 1400 | 1275 | CAGCUGGGCUCUGCAAUUCmUmU | 3306 | GAAUUGCAGAGCCCAGCUGmUmU |
| 1401 | 1276 | AGCUGGGCUCUGCAAUUCCmUmU | 3307 | GGAAUUGCAGAGCCCAGCUmUmU |
| 1402 | 1277 | GCUGGGCUCUGCAAUUCCCmUmU | 3308 | GGGAAUUGCAGAGCCCAGCmUmU |
| 1403 | 1278 | CUGGGCUCUGCAAUUCCCCmUmU | 3309 | GGGGAAUUGCAGAGCCCAGmUmU |
| 1404 | 1279 | UGGGCUCUGCAAUUCCCCUmUmU | 3310 | AGGGGAAUUGCAGAGCCCAmUmU |
| 1405 | 1280 | GGGCUCUGCAAUUCCCCUCmUmU | 3311 | GAGGGGAAUUGCAGAGCCCmUmU |
| 1406 | 1281 | GGCUCUGCAAUUCCCCUCUmUmU | 3312 | AGAGGGGAAUUGCAGAGCCmUmU |
| 1407 | 1282 | GCUCUGCAAUUCCCCUCUGmUmU | 3313 | CAGAGGGGAAUUGCAGAGCmUmU |
| 1408 | 1283 | CUCUGCAAUUCCCCUCUGCmUmU | 3314 | GCAGAGGGGAAUUGCAGAGmUmU |
| 1409 | 1284 | UCUGCAAUUCCCCUCUGCUmUmU | 3315 | AGCAGAGGGGAAUUGCAGAmUmU |
| 1410 | 1285 | CUGCAAUUCCCCUCUGCUGmUmU | 3316 | CAGCAGAGGGGAAUUGCAGmUmU |
| 1411 | 1286 | UGCAAUUCCCCUCUGCUGCmUmU | 3317 | GCAGCAGAGGGGAAUUGCAmUmU |
| 1412 | 1287 | GCAAUUCCCCUCUGCUGCUmUmU | 3318 | AGCAGCAGAGGGGAAUUGCmUmU |
| 1413 | 1288 | CAAUUCCCCUCUGCUGCUGmUmU | 3319 | CAGCAGCAGAGGGGAAUUGmUmU |
| 1414 | 1289 | AAUUCCCCUCUGCUGCUGUmUmU | 3320 | ACAGCAGCAGAGGGGAAUUmUmU |
| 1415 | 1290 | AUUCCCCUCUGCUGCUGUCmUmU | 3321 | GACAGCAGCAGAGGGGAAUmUmU |
| 1416 | 1291 | UUCCCCUCUGCUGCUGUCCmUmU | 3322 | GGACAGCAGCAGAGGGGAAmUmU |
| 1417 | 1292 | UCCCCUCUGCUGCUGUCCCmUmU | 3323 | GGGACAGCAGCAGAGGGGAmUmU |
| 1418 | 1293 | CCCCUCUGCUGCUGUCCCUmUmU | 3324 | AGGGACAGCAGCAGAGGGGmUmU |
| 1419 | 1294 | CCCUCUGCUGCUGUCCCUCmUmU | 3325 | GAGGGACAGCAGCAGAGGGmUmU |
| 1420 | 1295 | CCUCUGCUGCUGUCCCUCCmUmU | 3326 | GGAGGGACAGCAGCAGAGGmUmU |
| 1421 | 1296 | CUCUGCUGCUGUCCCUCCCmUmU | 3327 | GGGAGGGACAGCAGCAGAGmUmU |
| 1422 | 1297 | UCUGCUGCUGUCCCUCCCCmUmU | 3328 | GGGGAGGGACAGCAGCAGAmUmU |
| 1423 | 1298 | CUGCUGCUGUCCCUCCCCCmUmU | 3329 | GGGGGAGGGACAGCAGCAGmUmU |
| 1424 | 1299 | UGCUGCUGUCCCUCCCCCUmUmU | 3330 | AGGGGGAGGGACAGCAGCAmUmU |
| 1425 | 1300 | GCUGCUGUCCCUCCCCCUUmUmU | 3331 | AAGGGGGAGGGACAGCAGCmUmU |
| 1426 | 1301 | CUGCUGUCCCUCCCCCUUGmUmU | 3332 | CAAGGGGGAGGGACAGCAGmUmU |
| 1427 | 1302 | UGCUGUCCCUCCCCCUUGUmUmU | 3333 | ACAAGGGGGAGGGACAGCAmUmU |
| 1428 | 1303 | GCUGUCCCUCCCCCUUGUCmUmU | 3334 | GACAAGGGGGAGGGACAGCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1429 | 1304 | CUGUCCUCCCCCUUGUCCmUmU | 3335 | GGACAAGGGGGAGGGACAGmUmU |
| 1430 | 1305 | UGUCCUCCCCCUUGUCCUmUmU | 3336 | AGGACAAGGGGGAGGGACAmUmU |
| 1431 | 1306 | GUCCUCCCCCUUGUCCUUmUmU | 3337 | AAGGACAAGGGGGAGGGACmUmU |
| 1432 | 1307 | UCCCUCCCCCUUGUCCUUUmUmU | 3338 | AAAGGACAAGGGGGAGGGAmUmU |
| 1433 | 1308 | CCCUCCCCCUUGUCCUUUCmUmU | 3339 | GAAAGGACAAGGGGGAGGGmUmU |
| 1434 | 1309 | CCUCCCCCUUGUCCUUUCCmUmU | 3340 | GGAAAGGACAAGGGGGAGGmUmU |
| 1435 | 1310 | CUCCCCCUUGUCCUUUCCCmUmU | 3341 | GGGAAAGGACAAGGGGGAGmUmU |
| 1436 | 1311 | UCCCCCUUGUCCUUUCCCUmUmU | 3342 | AGGGAAAGGACAAGGGGGAmUmU |
| 1437 | 1312 | CCCCCUUGUCCUUUCCCUUmUmU | 3343 | AAGGGAAAGGACAAGGGGGmUmU |
| 1438 | 1313 | CCCCUUGUCCUUUCCCUUCmUmU | 3344 | GAAGGGAAAGGACAAGGGGmUmU |
| 1439 | 1314 | CCCUUGUCCUUUCCCUUCAmUmU | 3345 | UGAAGGGAAAGGACAAGGGmUmU |
| 1440 | 1315 | CCUUGUCCUUUCCCUUCAGmUmU | 3346 | CUGAAGGGAAAGGACAAGGmUmU |
| 1441 | 1316 | CUUGUCCUUUCCCUUCAGUmUmU | 3347 | ACUGAAGGGAAAGGACAAGmUmU |
| 1442 | 1317 | UUGUCCUUUCCCUUCAGUAmUmU | 3348 | UACUGAAGGGAAAGGACAAmUmU |
| 1443 | 1318 | UGUCCUUUCCCUUCAGUACmUmU | 3349 | GUACUGAAGGGAAAGGACAmUmU |
| 1444 | 1319 | GUCCUUUCCCUUCAGUACCmUmU | 3350 | GGUACUGAAGGGAAAGGACmUmU |
| 1445 | 1320 | UCCUUUCCCUUCAGUACCCmUmU | 3351 | GGGUACUGAAGGGAAAGGAmUmU |
| 1446 | 1321 | CCUUUCCCUUCAGUACCCUmUmU | 3352 | AGGGUACUGAAGGGAAAGGmUmU |
| 1447 | 1322 | CUUUCCCUUCAGUACCCUCmUmU | 3353 | GAGGGUACUGAAGGGAAAGmUmU |
| 1448 | 1323 | UUUCCCUUCAGUACCCUCUmUmU | 3354 | AGAGGGUACUGAAGGGAAAmUmU |
| 1449 | 1324 | UUCCCUUCAGUACCCUCUCmUmU | 3355 | GAGAGGGUACUGAAGGGAAmUmU |
| 1450 | 1325 | UCCCUUCAGUACCCUCUCAmUmU | 3356 | UGAGAGGGUACUGAAGGGAmUmU |
| 1451 | 1326 | CCCUUCAGUACCCUCUCAGmUmU | 3357 | CUGAGAGGGUACUGAAGGGmUmU |
| 1452 | 1327 | CCUUCAGUACCCUCUCAGCmUmU | 3358 | GCUGAGAGGGUACUGAAGGmUmU |
| 1453 | 1328 | CUUCAGUACCCUCUCAGCUmUmU | 3359 | AGCUGAGAGGGUACUGAAGmUmU |
| 1454 | 1329 | UUCAGUACCCUCUCAGCUCmUmU | 3360 | GAGCUGAGAGGGUACUGAAmUmU |
| 1455 | 1330 | UCAGUACCCUCUCAGCUCCmUmU | 3361 | GGAGCUGAGAGGGUACUGAmUmU |
| 1456 | 1331 | CAGUACCCUCUCAGCUCCAmUmU | 3362 | UGGAGCUGAGAGGGUACUGmUmU |
| 1457 | 1332 | AGUACCCUCUCAGCUCCAGmUmU | 3363 | CUGGAGCUGAGAGGGUACUmUmU |
| 1458 | 1333 | GUACCCUCUCAGCUCCAGGmUmU | 3364 | CCUGGAGCUGAGAGGGUACmUmU |
| 1459 | 1334 | UACCCUCUCAGCUCCAGGUmUmU | 3365 | ACCUGGAGCUGAGAGGGUAmUmU |
| 1460 | 1335 | ACCCUCUCAGCUCCAGGUGmUmU | 3366 | CACCUGGAGCUGAGAGGGUmUmU |
| 1461 | 1336 | CCCUCUCAGCUCCAGGUGGmUmU | 3367 | CCACCUGGAGCUGAGAGGGmUmU |
| 1462 | 1337 | CCUCUCAGCUCCAGGUGGCmUmU | 3368 | GCCACCUGGAGCUGAGAGGmUmU |
| 1463 | 1338 | CUCUCAGCUCCAGGUGGCUmUmU | 3369 | AGCCACCUGGAGCUGAGAGmUmU |
| 1464 | 1339 | UCUCAGCUCCAGGUGGCUCmUmU | 3370 | GAGCCACCUGGAGCUGAGAmUmU |
| 1465 | 1340 | CUCAGCUCCAGGUGGCUCUmUmU | 3371 | AGAGCCACCUGGAGCUGAGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1466 | 1341 | UCAGCUCCAGGUGGCUCUGmUmU | 3372 | CAGAGCCACCUGGAGCUGAmUmU |
| 1467 | 1342 | CAGCUCCAGGUGGCUCUGAmUmU | 3373 | UCAGAGCCACCUGGAGCUGmUmU |
| 1468 | 1343 | AGCUCCAGGUGGCUCUGAGmUmU | 3374 | CUCAGAGCCACCUGGAGCUmUmU |
| 1469 | 1344 | GCUCCAGGUGGCUCUGAGGmUmU | 3375 | CCUCAGAGCCACCUGGAGCmUmU |
| 1470 | 1345 | CUCCAGGUGGCUCUGAGGUmUmU | 3376 | ACCUCAGAGCCACCUGGAGmUmU |
| 1471 | 1346 | UCCAGGUGGCUCUGAGGUGmUmU | 3377 | CACCUCAGAGCCACCUGGAmUmU |
| 1472 | 1347 | CCAGGUGGCUCUGAGGUGCmUmU | 3378 | GCACCUCAGAGCCACCUGGmUmU |
| 1473 | 1348 | CAGGUGGCUCUGAGGUGCCmUmU | 3379 | GGCACCUCAGAGCCACCUGmUmU |
| 1474 | 1349 | AGGUGGCUCUGAGGUGCCUmUmU | 3380 | AGGCACCUCAGAGCCACCUmUmU |
| 1475 | 1350 | GGUGGCUCUGAGGUGCCUGmUmU | 3381 | CAGGCACCUCAGAGCCACCmUmU |
| 1476 | 1351 | GUGGCUCUGAGGUGCCUGUmUmU | 3382 | ACAGGCACCUCAGAGCCACmUmU |
| 1477 | 1352 | UGGCUCUGAGGUGCCUGUCmUmU | 3383 | GACAGGCACCUCAGAGCCAmUmU |
| 1478 | 1353 | GGCUCUGAGGUGCCUGUCCmUmU | 3384 | GGACAGGCACCUCAGAGCCmUmU |
| 1479 | 1354 | GCUCUGAGGUGCCUGUCCCmUmU | 3385 | GGGACAGGCACCUCAGAGCmUmU |
| 1480 | 1355 | CUCUGAGGUGCCUGUCCCAmUmU | 3386 | UGGGACAGGCACCUCAGAGmUmU |
| 1481 | 1356 | UCUGAGGUGCCUGUCCCACmUmU | 3387 | GUGGGACAGGCACCUCAGAmUmU |
| 1482 | 1357 | CUGAGGUGCCUGUCCCACCmUmU | 3388 | GGUGGGACAGGCACCUCAGmUmU |
| 1483 | 1358 | UGAGGUGCCUGUCCCACCCmUmU | 3389 | GGGUGGGACAGGCACCUCAmUmU |
| 1484 | 1359 | GAGGUGCCUGUCCCACCCCmUmU | 3390 | GGGGUGGGACAGGCACCUCmUmU |
| 1485 | 1360 | AGGUGCCUGUCCCACCCCCmUmU | 3391 | GGGGGUGGGACAGGCACCUmUmU |
| 1486 | 1361 | GGUGCCUGUCCCACCCCCAmUmU | 3392 | UGGGGGUGGGACAGGCACCmUmU |
| 1487 | 1362 | GUGCCUGUCCCACCCCCACmUmU | 3393 | GUGGGGGUGGGACAGGCACmUmU |
| 1488 | 1363 | UGCCUGUCCCACCCCCACCmUmU | 3394 | GGUGGGGGUGGGACAGGCAmUmU |
| 1489 | 1364 | GCCUGUCCCACCCCCACCCmUmU | 3395 | GGGUGGGGGUGGGACAGGCmUmU |
| 1490 | 1365 | CCUGUCCCACCCCCACCCCmUmU | 3396 | GGGGUGGGGGUGGGACAGGmUmU |
| 1491 | 1366 | CUGUCCCACCCCCACCCCCmUmU | 3397 | GGGGGUGGGGGUGGGACAGmUmU |
| 1492 | 1367 | UGUCCCACCCCCACCCCCAmUmU | 3398 | UGGGGGUGGGGGUGGGACAmUmU |
| 1493 | 1368 | GUCCCACCCCCACCCCCAGmUmU | 3399 | CUGGGGGUGGGGGUGGGACmUmU |
| 1494 | 1369 | UCCCACCCCCACCCCCAGCmUmU | 3400 | GCUGGGGGUGGGGGUGGGAmUmU |
| 1495 | 1370 | CCCACCCCCACCCCCAGCUmUmU | 3401 | AGCUGGGGGUGGGGGUGGGmUmU |
| 1496 | 1371 | CCACCCCCACCCCCAGCUCmUmU | 3402 | GAGCUGGGGGUGGGGGUGGmUmU |
| 1497 | 1372 | CACCCCCACCCCCAGCUCAmUmU | 3403 | UGAGCUGGGGGUGGGGGUGmUmU |
| 1498 | 1373 | ACCCCCACCCCCAGCUCAAmUmU | 3404 | UUGAGCUGGGGGUGGGGGUmUmU |
| 1499 | 1374 | CCCCCACCCCCAGCUCAAUmUmU | 3405 | AUUGAGCUGGGGGUGGGGGmUmU |
| 1500 | 1375 | CCCCACCCCCAGCUCAAUGmUmU | 3406 | CAUUGAGCUGGGGGUGGGGmUmU |
| 1501 | 1376 | CCCACCCCCAGCUCAAUGGmUmU | 3407 | CCAUUGAGCUGGGGGUGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1502 | 1377 | CCACCCCCAGCUCAAUGGAmUmU | 3408 | UCCAUUGAGCUGGGGGUGGmUmU |
| 1503 | 1378 | CACCCCCAGCUCAAUGGACmUmU | 3409 | GUCCAUUGAGCUGGGGGUGmUmU |
| 1504 | 1379 | ACCCCCAGCUCAAUGGACUmUmU | 3410 | AGUCCAUUGAGCUGGGGGUmUmU |
| 1505 | 1380 | CCCCCAGCUCAAUGGACUGmUmU | 3411 | CAGUCCAUUGAGCUGGGGGmUmU |
| 1506 | 1381 | CCCCAGCUCAAUGGACUGGmUmU | 3412 | CCAGUCCAUUGAGCUGGGGmUmU |
| 1507 | 1382 | CCCAGCUCAAUGGACUGGAmUmU | 3413 | UCCAGUCCAUUGAGCUGGGmUmU |
| 1508 | 1383 | CCAGCUCAAUGGACUGGAAmUmU | 3414 | UUCCAGUCCAUUGAGCUGGmUmU |
| 1509 | 1384 | CAGCUCAAUGGACUGGAAGmUmU | 3415 | CUUCCAGUCCAUUGAGCUGmUmU |
| 1510 | 1385 | AGCUCAAUGGACUGGAAGGmUmU | 3416 | CCUUCCAGUCCAUUGAGCUmUmU |
| 1511 | 1386 | GCUCAAUGGACUGGAAGGGmUmU | 3417 | CCCUUCCAGUCCAUUGAGCmUmU |
| 1512 | 1387 | CUCAAUGGACUGGAAGGGGmUmU | 3418 | CCCCUUCCAGUCCAUUGAGmUmU |
| 1513 | 1388 | UCAAUGGACUGGAAGGGGAmUmU | 3419 | UCCCCUUCCAGUCCAUUGAmUmU |
| 1514 | 1389 | CAAUGGACUGGAAGGGGAAmUmU | 3420 | UUCCCCUUCCAGUCCAUUGmUmU |
| 1515 | 1390 | AAUGGACUGGAAGGGGAAGmUmU | 3421 | CUUCCCCUUCCAGUCCAUUmUmU |
| 1516 | 1391 | AUGGACUGGAAGGGGAAGGmUmU | 3422 | CCUUCCCCUUCCAGUCCAUmUmU |
| 1517 | 1392 | UGGACUGGAAGGGGAAGGGmUmU | 3423 | CCCUUCCCCUUCCAGUCCAmUmU |
| 1518 | 1393 | GGACUGGAAGGGGAAGGGAmUmU | 3424 | UCCCUUCCCCUUCCAGUCCmUmU |
| 1519 | 1394 | GACUGGAAGGGGAAGGGACmUmU | 3425 | GUCCCUUCCCCUUCCAGUCmUmU |
| 1520 | 1395 | ACUGGAAGGGGAAGGGACAmUmU | 3426 | UGUCCCUUCCCCUUCCAGUmUmU |
| 1521 | 1396 | CUGGAAGGGGAAGGGACACmUmU | 3427 | GUGUCCCUUCCCCUUCCAGmUmU |
| 1522 | 1397 | UGGAAGGGGAAGGGACACAmUmU | 3428 | UGUGUCCCUUCCCCUUCCAmUmU |
| 1523 | 1398 | GGAAGGGGAAGGGACACACmUmU | 3429 | GUGUGUCCCUUCCCCUUCCmUmU |
| 1524 | 1399 | GAAGGGGAAGGGACACACAmUmU | 3430 | UGUGUGUCCCUUCCCCUUCmUmU |
| 1525 | 1400 | AAGGGGAAGGGACACACAAmUmU | 3431 | UUGUGUGUCCCUUCCCCUUmUmU |
| 1526 | 1401 | AGGGGAAGGGACACACAAGmUmU | 3432 | CUUGUGUGUCCCUUCCCCUmUmU |
| 1527 | 1402 | GGGGAAGGGACACACAAGAmUmU | 3433 | UCUUGUGUGUCCCUUCCCCmUmU |
| 1528 | 1403 | GGGAAGGGACACACAAGAAmUmU | 3434 | UUCUUGUGUGUCCCUUCCCmUmU |
| 1529 | 1404 | GGAAGGGACACACAAGAAGmUmU | 3435 | CUUCUUGUGUGUCCCUUCCmUmU |
| 1530 | 1405 | GAAGGGACACACAAGAAGAmUmU | 3436 | UCUUCUUGUGUGUCCCUUCmUmU |
| 1531 | 1406 | AAGGGACACACAAGAAGAAmUmU | 3437 | UUCUUCUUGUGUGUCCCUUmUmU |
| 1532 | 1407 | AGGGACACACAAGAAGAAGmUmU | 3438 | CUUCUUCUUGUGUGUCCCUmUmU |
| 1533 | 1408 | GGGACACACAAGAAGAAGGmUmU | 3439 | CCUUCUUCUUGUGUGUCCCmUmU |
| 1534 | 1409 | GGACACACAAGAAGAAGGGmUmU | 3440 | CCCUUCUUCUUGUGUGUCCmUmU |
| 1535 | 1410 | GACACACAAGAAGAAGGGCmUmU | 3441 | GCCCUUCUUCUUGUGUGUCmUmU |
| 1536 | 1411 | ACACACAAGAAGAAGGGCAmUmU | 3442 | UGCCCUUCUUCUUGUGUGUmUmU |
| 1537 | 1412 | CACACAAGAAGAAGGGCACmUmU | 3443 | GUGCCCUUCUUCUUGUGUGmUmU |
| 1538 | 1413 | ACACAAGAAGAAGGGCACCmUmU | 3444 | GGUGCCCUUCUUCUUGUGUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1539 | 1414 | CACAAGAAGAAGGGCACCCmUmU | 3445 | GGGUGCCCUUCUUCUUGUGmUmU |
| 1540 | 1415 | ACAAGAAGAAGGGCACCCUmUmU | 3446 | AGGGUGCCCUUCUUCUUGmUmU |
| 1541 | 1416 | CAAGAAGAAGGGCACCCUAmUmU | 3447 | UAGGGUGCCCUUCUUCUUGmUmU |
| 1542 | 1417 | AAGAAGAAGGGCACCCUAGmUmU | 3448 | CUAGGGUGCCCUUCUUCUUmUmU |
| 1543 | 1418 | AGAAGAAGGGCACCCUAGUmUmU | 3449 | ACUAGGGUGCCCUUCUUCmUmU |
| 1544 | 1419 | GAAGAAGGGCACCCUAGUUmUmU | 3450 | AACUAGGGUGCCCUUCUUCmUmU |
| 1545 | 1420 | AAGAAGGGCACCCUAGUUCmUmU | 3451 | GAACUAGGGUGCCCUUCUUmUmU |
| 1546 | 1421 | AGAAGGGCACCCUAGUUCUmUmU | 3452 | AGAACUAGGGUGCCCUUCUmUmU |
| 1547 | 1422 | GAAGGGCACCCUAGUUCUAmUmU | 3453 | UAGAACUAGGGUGCCCUUCmUmU |
| 1548 | 1423 | AAGGGCACCCUAGUUCUACmUmU | 3454 | GUAGAACUAGGGUGCCCUUmUmU |
| 1549 | 1424 | AGGGCACCCUAGUUCUACCmUmU | 3455 | GGUAGAACUAGGGUGCCCUmUmU |
| 1550 | 1425 | GGGCACCCUAGUUCUACCUmUmU | 3456 | AGGUAGAACUAGGGUGCCCmUmU |
| 1551 | 1426 | GGCACCCUAGUUCUACCUCmUmU | 3457 | GAGGUAGAACUAGGGUGCCmUmU |
| 1552 | 1427 | GCACCCUAGUUCUACCUCAmUmU | 3458 | UGAGGUAGAACUAGGGUGCmUmU |
| 1553 | 1428 | CACCCUAGUUCUACCUCAGmUmU | 3459 | CUGAGGUAGAACUAGGGUGmUmU |
| 1554 | 1429 | ACCCUAGUUCUACCUCAGGmUmU | 3460 | CCUGAGGUAGAACUAGGGUmUmU |
| 1555 | 1430 | CCCUAGUUCUACCUCAGGCmUmU | 3461 | GCCUGAGGUAGAACUAGGGmUmU |
| 1556 | 1431 | CCUAGUUCUACCUCAGGCAmUmU | 3462 | UGCCUGAGGUAGAACUAGGmUmU |
| 1557 | 1432 | CUAGUUCUACCUCAGGCAGmUmU | 3463 | CUGCCUGAGGUAGAACUAGmUmU |
| 1558 | 1433 | UAGUUCUACCUCAGGCAGCmUmU | 3464 | GCUGCCUGAGGUAGAACUAmUmU |
| 1559 | 1434 | AGUUCUACCUCAGGCAGCUmUmU | 3465 | AGCUGCCUGAGGUAGAACUmUmU |
| 1560 | 1435 | GUUCUACCUCAGGCAGCUCmUmU | 3466 | GAGCUGCCUGAGGUAGAACmUmU |
| 1561 | 1436 | UUCUACCUCAGGCAGCUCAmUmU | 3467 | UGAGCUGCCUGAGGUAGAAmUmU |
| 1562 | 1437 | UCUACCUCAGGCAGCUCAAmUmU | 3468 | UUGAGCUGCCUGAGGUAGAmUmU |
| 1563 | 1438 | CUACCUCAGGCAGCUCAAGmUmU | 3469 | CUUGAGCUGCCUGAGGUAGmUmU |
| 1564 | 1439 | UACCUCAGGCAGCUCAAGCmUmU | 3470 | GCUUGAGCUGCCUGAGGUAmUmU |
| 1565 | 1440 | ACCUCAGGCAGCUCAAGCAmUmU | 3471 | UGCUUGAGCUGCCUGAGGUmUmU |
| 1566 | 1441 | CCUCAGGCAGCUCAAGCAGmUmU | 3472 | CUGCUUGAGCUGCCUGAGGmUmU |
| 1567 | 1442 | CUCAGGCAGCUCAAGCAGCmUmU | 3473 | GCUGCUUGAGCUGCCUGAGmUmU |
| 1568 | 1443 | UCAGGCAGCUCAAGCAGCGmUmU | 3474 | CGCUGCUUGAGCUGCCUGAmUmU |
| 1569 | 1444 | CAGGCAGCUCAAGCAGCGAmUmU | 3475 | UCGCUGCUUGAGCUGCCUGmUmU |
| 1570 | 1445 | AGGCAGCUCAAGCAGCGACmUmU | 3476 | GUCGCUGCUUGAGCUGCCUmUmU |
| 1571 | 1446 | GGCAGCUCAAGCAGCGACCmUmU | 3477 | GGUCGCUGCUUGAGCUGCCmUmU |
| 1572 | 1447 | GCAGCUCAAGCAGCGACCGmUmU | 3478 | CGGUCGCUGCUUGAGCUGCmUmU |
| 1573 | 1448 | CAGCUCAAGCAGCGACCGCmUmU | 3479 | GCGGUCGCUGCUUGAGCUGmUmU |
| 1574 | 1449 | AGCUCAAGCAGCGACCGCCmUmU | 3480 | GGCGGUCGCUGCUUGAGCUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1575 | 1450 | GCUCAAGCAGCGACCGCCCmUmU | 3481 | GGGCGGUCGCUGCUUGAGCmUmU |
| 1576 | 1451 | CUCAAGCAGCGACCGCCCCmUmU | 3482 | GGGGCGGUCGCUGCUUGAGmUmU |
| 1577 | 1452 | UCAAGCAGCGACCGCCCCCmUmU | 3483 | GGGGGCGGUCGCUGCUUGAmUmU |
| 1578 | 1453 | CAAGCAGCGACCGCCCCCUmUmU | 3484 | AGGGGGCGGUCGCUGCUUGmUmU |
| 1579 | 1454 | AAGCAGCGACCGCCCCCUCmUmU | 3485 | GAGGGGGCGGUCGCUGCUUmUmU |
| 1580 | 1455 | AGCAGCGACCGCCCCCUCCmUmU | 3486 | GGAGGGGGCGGUCGCUGCmUmU |
| 1581 | 1456 | GCAGCGACCGCCCCCUCCUmUmU | 3487 | AGGAGGGGGCGGUCGCUGCmUmU |
| 1582 | 1457 | CAGCGACCGCCCCCUCCUCmUmU | 3488 | GAGGAGGGGGCGGUCGCUGmUmU |
| 1583 | 1458 | AGCGACCGCCCCCUCCUCUmUmU | 3489 | AGAGGAGGGGGCGGUCGCUmUmU |
| 1584 | 1459 | GCGACCGCCCCCUCCUCUAmUmU | 3490 | UAGAGGAGGGGGCGGUCGCmUmU |
| 1585 | 1460 | CGACCGCCCCCUCCUCUAGmUmU | 3491 | CUAGAGGAGGGGGCGGUCGmUmU |
| 1586 | 1461 | GACCGCCCCCUCCUCUAGCmUmU | 3492 | GCUAGAGGAGGGGGCGGUCmUmU |
| 1587 | 1462 | ACCGCCCCCUCCUCUAGCUmUmU | 3493 | AGCUAGAGGAGGGGGCGGUmUmU |
| 1588 | 1463 | CCGCCCCCUCCUCUAGCUGmUmU | 3494 | CAGCUAGAGGAGGGGGCGGmUmU |
| 1589 | 1464 | CGCCCCCUCCUCUAGCUGUmUmU | 3495 | ACAGCUAGAGGAGGGGGCGmUmU |
| 1590 | 1465 | GCCCCCUCCUCUAGCUGUGmUmU | 3496 | CACAGCUAGAGGAGGGGGCmUmU |
| 1591 | 1466 | CCCCCUCCUCUAGCUGUGGmUmU | 3497 | CCACAGCUAGAGGAGGGGGmUmU |
| 1592 | 1467 | CCCCUCCUCUAGCUGUGGGmUmU | 3498 | CCCACAGCUAGAGGAGGGGmUmU |
| 1593 | 1468 | CCCUCCUCUAGCUGUGGGGmUmU | 3499 | CCCCACAGCUAGAGGAGGGmUmU |
| 1594 | 1469 | CCUCCUCUAGCUGUGGGGGmUmU | 3500 | CCCCCACAGCUAGAGGAGGmUmU |
| 1595 | 1470 | CUCCUCUAGCUGUGGGGGUmUmU | 3501 | ACCCCCACAGCUAGAGGAGmUmU |
| 1596 | 1471 | UCCUCUAGCUGUGGGGGUGmUmU | 3502 | CACCCCCACAGCUAGAGGAmUmU |
| 1597 | 1472 | CCUCUAGCUGUGGGGGUGAmUmU | 3503 | UCACCCCCACAGCUAGAGGmUmU |
| 1598 | 1473 | CUCUAGCUGUGGGGGUGAGmUmU | 3504 | CUCACCCCCACAGCUAGAGmUmU |
| 1599 | 1474 | UCUAGCUGUGGGGGUGAGGmUmU | 3505 | CCUCACCCCCACAGCUAGAmUmU |
| 1600 | 1475 | CUAGCUGUGGGGGUGAGGGmUmU | 3506 | CCCUCACCCCCACAGCUAGmUmU |
| 1601 | 1476 | UAGCUGUGGGGGUGAGGGUmUmU | 3507 | ACCCUCACCCCCACAGCUAmUmU |
| 1602 | 1477 | AGCUGUGGGGGUGAGGGUCmUmU | 3508 | GACCCUCACCCCCACAGCUmUmU |
| 1603 | 1478 | GCUGUGGGGGUGAGGGUCCmUmU | 3509 | GGACCCUCACCCCCACAGCmUmU |
| 1604 | 1479 | CUGUGGGGGUGAGGGUCCCmUmU | 3510 | GGGACCCUCACCCCCACAGmUmU |
| 1605 | 1480 | UGUGGGGGUGAGGGUCCCAmUmU | 3511 | UGGGACCCUCACCCCCACAmUmU |
| 1606 | 1481 | GUGGGGGUGAGGGUCCCAUmUmU | 3512 | AUGGGACCCUCACCCCCACmUmU |
| 1607 | 1482 | UGGGGGUGAGGGUCCCAUGmUmU | 3513 | CAUGGGACCCUCACCCCCAmUmU |
| 1608 | 1483 | GGGGGUGAGGGUCCCAUGUmUmU | 3514 | ACAUGGGACCCUCACCCCCmUmU |
| 1609 | 1484 | GGGGUGAGGGUCCCAUGUGmUmU | 3515 | CACAUGGGACCCUCACCCCmUmU |
| 1610 | 1485 | GGGUGAGGGUCCCAUGUGGmUmU | 3516 | CCACAUGGGACCCUCACCCmUmU |
| 1611 | 1486 | GGUGAGGGUCCCAUGUGGUmUmU | 3517 | ACCACAUGGGACCCUCACCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1612 | 1487 | GUGAGGGUCCCAUGUGGUGmUmU | 3518 | CACCACAUGGGACCCUCACmUmU |
| 1613 | 1488 | UGAGGGUCCCAUGUGGUGGmUmU | 3519 | CCACCACAUGGGACCCUCAmUmU |
| 1614 | 1489 | GAGGGUCCCAUGUGGUGGCmUmU | 3520 | GCCACCACAUGGGACCCUCmUmU |
| 1615 | 1490 | AGGGUCCCAUGUGGUGGCAmUmU | 3521 | UGCCACCACAUGGGACCCUmUmU |
| 1616 | 1491 | GGGUCCCAUGUGGUGGCACmUmU | 3522 | GUGCCACCACAUGGGACCCmUmU |
| 1617 | 1492 | GGUCCCAUGUGGUGGCACAmUmU | 3523 | UGUGCCACCACAUGGGACCmUmU |
| 1618 | 1493 | GUCCCAUGUGGUGGCACAGmUmU | 3524 | CUGUGCCACCACAUGGGACmUmU |
| 1619 | 1494 | UCCCAUGUGGUGGCACAGGmUmU | 3525 | CCUGUGCCACCACAUGGGAmUmU |
| 1620 | 1495 | CCCAUGUGGUGGCACAGGCmUmU | 3526 | GCCUGUGCCACCACAUGGGmUmU |
| 1621 | 1496 | CCAUGUGGUGGCACAGGCCmUmU | 3527 | GGCCUGUGCCACCACAUGGmUmU |
| 1622 | 1497 | CAUGUGGUGGCACAGGCCCmUmU | 3528 | GGGCCUGUGCCACCACAUGmUmU |
| 1623 | 1498 | AUGUGGUGGCACAGGCCCCmUmU | 3529 | GGGGCCUGUGCCACCACAUmUmU |
| 1624 | 1499 | UGUGGUGGCACAGGCCCCCmUmU | 3530 | GGGGGCCUGUGCCACCACAmUmU |
| 1625 | 1500 | GUGGUGGCACAGGCCCCCUmUmU | 3531 | AGGGGGCCUGUGCCACCACmUmU |
| 1626 | 1501 | UGGUGGCACAGGCCCCCUUmUmU | 3532 | AAGGGGGCCUGUGCCACCAmUmU |
| 1627 | 1502 | GGUGGCACAGGCCCCCUUGmUmU | 3533 | CAAGGGGGCCUGUGCCACCmUmU |
| 1628 | 1503 | GUGGCACAGGCCCCCUUGAmUmU | 3534 | UCAAGGGGGCCUGUGCCACmUmU |
| 1629 | 1504 | UGGCACAGGCCCCCUUGAGmUmU | 3535 | CUCAAGGGGGCCUGUGCCAmUmU |
| 1630 | 1505 | GGCACAGGCCCCCUUGAGUmUmU | 3536 | ACUCAAGGGGGCCUGUGCCmUmU |
| 1631 | 1506 | GCACAGGCCCCCUUGAGUGmUmU | 3537 | CACUCAAGGGGGCCUGUGCmUmU |
| 1632 | 1507 | CACAGGCCCCCUUGAGUGGmUmU | 3538 | CCACUCAAGGGGGCCUGUGmUmU |
| 1633 | 1508 | ACAGGCCCCCUUGAGUGGGmUmU | 3539 | CCCACUCAAGGGGGCCUGUmUmU |
| 1634 | 1509 | CAGGCCCCCUUGAGUGGGGmUmU | 3540 | CCCCACUCAAGGGGGCCUGmUmU |
| 1635 | 1510 | AGGCCCCCUUGAGUGGGGUmUmU | 3541 | ACCCCACUCAAGGGGGCCUmUmU |
| 1636 | 1511 | GGCCCCCUUGAGUGGGGUUmUmU | 3542 | AACCCCACUCAAGGGGGCCmUmU |
| 1637 | 1512 | GCCCCCUUGAGUGGGGUUAmUmU | 3543 | UAACCCCACUCAAGGGGGCmUmU |
| 1638 | 1513 | CCCCCUUGAGUGGGGUUAUmUmU | 3544 | AUAACCCCACUCAAGGGGGmUmU |
| 1639 | 1514 | CCCCUUGAGUGGGGUUAUCmUmU | 3545 | GAUAACCCCACUCAAGGGGmUmU |
| 1640 | 1515 | CCCUUGAGUGGGGUUAUCUmUmU | 3546 | AGAUAACCCCACUCAAGGGmUmU |
| 1641 | 1516 | CCUUGAGUGGGGUUAUCUCmUmU | 3547 | GAGAUAACCCCACUCAAGGmUmU |
| 1642 | 1517 | CUUGAGUGGGGUUAUCUCUmUmU | 3548 | AGAGAUAACCCCACUCAAGmUmU |
| 1643 | 1518 | UUGAGUGGGGUUAUCUCUGmUmU | 3549 | CAGAGAUAACCCCACUCAAmUmU |
| 1644 | 1519 | UGAGUGGGGUUAUCUCUGUmUmU | 3550 | ACAGAGAUAACCCCACUCAmUmU |
| 1645 | 1520 | GAGUGGGGUUAUCUCUGUGmUmU | 3551 | CACAGAGAUAACCCCACUCmUmU |
| 1646 | 1521 | AGUGGGGUUAUCUCUGUGUmUmU | 3552 | ACACAGAGAUAACCCCACUmUmU |
| 1647 | 1522 | GUGGGGUUAUCUCUGUGUUmUmU | 3553 | AACACAGAGAUAACCCCACmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1648 | 1523 | UGGGGUUAUCUCUGUGUUAmUmU | 3554 | UAACACAGAGAUAACCCCAmUmU |
| 1649 | 1524 | GGGGUUAUCUCUGUGUUAGmUmU | 3555 | CUAACACAGAGAUAACCCCmUmU |
| 1650 | 1525 | GGGUUAUCUCUGUGUUAGGmUmU | 3556 | CCUAACACAGAGAUAACCCmUmU |
| 1651 | 1526 | GGUUAUCUCUGUGUUAGGGmUmU | 3557 | CCCUAACACAGAGAUAACCmUmU |
| 1652 | 1527 | GUUAUCUCUGUGUUAGGGGmUmU | 3558 | CCCCUAACACAGAGAUAACmUmU |
| 1653 | 1528 | UUAUCUCUGUGUUAGGGGUmUmU | 3559 | ACCCCUAACACAGAGAUAAmUmU |
| 1654 | 1529 | UAUCUCUGUGUUAGGGGUAmUmU | 3560 | UACCCCUAACACAGAGAUAmUmU |
| 1655 | 1530 | AUCUCUGUGUUAGGGGUAUmUmU | 3561 | AUACCCCUAACACAGAGAUmUmU |
| 1656 | 1531 | UCUCUGUGUUAGGGGUAUAmUmU | 3562 | UAUACCCCUAACACAGAGAmUmU |
| 1657 | 1532 | CUCUGUGUUAGGGGUAUAUmUmU | 3563 | AUAUACCCCUAACACAGAGmUmU |
| 1658 | 1533 | UCUGUGUUAGGGGUAUAUGmUmU | 3564 | CAUAUACCCCUAACACAGAmUmU |
| 1659 | 1534 | CUGUGUUAGGGGUAUAUGAmUmU | 3565 | UCAUAUACCCCUAACACAGmUmU |
| 1660 | 1535 | UGUGUUAGGGGUAUAUGAUmUmU | 3566 | AUCAUAUACCCCUAACACAmUmU |
| 1661 | 1536 | GUGUUAGGGGUAUAUGAUGmUmU | 3567 | CAUCAUAUACCCCUAACACmUmU |
| 1662 | 1537 | UGUUAGGGGUAUAUGAUGGmUmU | 3568 | CCAUCAUAUACCCCUAACAmUmU |
| 1663 | 1538 | GUUAGGGGUAUAUGAUGGGmUmU | 3569 | CCCAUCAUAUACCCCUAACmUmU |
| 1664 | 1539 | UUAGGGGUAUAUGAUGGGGmUmU | 3570 | CCCCAUCAUAUACCCCUAAmUmU |
| 1665 | 1540 | UAGGGGUAUAUGAUGGGGGmUmU | 3571 | CCCCCAUCAUAUACCCCUAmUmU |
| 1666 | 1541 | AGGGGUAUAUGAUGGGGGAmUmU | 3572 | UCCCCCAUCAUAUACCCCUmUmU |
| 1667 | 1542 | GGGGUAUAUGAUGGGGGAGmUmU | 3573 | CUCCCCCAUCAUAUACCCCmUmU |
| 1668 | 1543 | GGGUAUAUGAUGGGGGAGUmUmU | 3574 | ACUCCCCCAUCAUAUACCCmUmU |
| 1669 | 1544 | GGUAUAUGAUGGGGGAGUAmUmU | 3575 | UACUCCCCCAUCAUAUACCmUmU |
| 1670 | 1545 | GUAUAUGAUGGGGGAGUAGmUmU | 3576 | CUACUCCCCCAUCAUAUACmUmU |
| 1671 | 1546 | UAUAUGAUGGGGGAGUAGAmUmU | 3577 | UCUACUCCCCCAUCAUAUAmUmU |
| 1672 | 1547 | AUAUGAUGGGGGAGUAGAUmUmU | 3578 | AUCUACUCCCCCAUCAUAUmUmU |
| 1673 | 1548 | UAUGAUGGGGGAGUAGAUCmUmU | 3579 | GAUCUACUCCCCCAUCAUAmUmU |
| 1674 | 1549 | AUGAUGGGGGAGUAGAUCUmUmU | 3580 | AGAUCUACUCCCCCAUCAUmUmU |
| 1675 | 1550 | UGAUGGGGGAGUAGAUCUUmUmU | 3581 | AAGAUCUACUCCCCCAUCAmUmU |
| 1676 | 1551 | GAUGGGGGAGUAGAUCUUUmUmU | 3582 | AAAGAUCUACUCCCCCAUCmUmU |
| 1677 | 1552 | AUGGGGGAGUAGAUCUUUCmUmU | 3583 | GAAAGAUCUACUCCCCCAUmUmU |
| 1678 | 1553 | UGGGGGAGUAGAUCUUUCUmUmU | 3584 | AGAAAGAUCUACUCCCCCAmUmU |
| 1679 | 1554 | GGGGGAGUAGAUCUUUCUAmUmU | 3585 | UAGAAAGAUCUACUCCCCCmUmU |
| 1680 | 1555 | GGGGAGUAGAUCUUUCUAGmUmU | 3586 | CUAGAAAGAUCUACUCCCCmUmU |
| 1681 | 1556 | GGGAGUAGAUCUUUCUAGGmUmU | 3587 | CCUAGAAAGAUCUACUCCCmUmU |
| 1682 | 1557 | GGAGUAGAUCUUUCUAGGAmUmU | 3588 | UCCUAGAAAGAUCUACUCCmUmU |
| 1683 | 1558 | GAGUAGAUCUUUCUAGGAGmUmU | 3589 | CUCCUAGAAAGAUCUACUCmUmU |
| 1684 | 1559 | AGUAGAUCUUUCUAGGAGGmUmU | 3590 | CCUCCUAGAAAGAUCUACUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1685 | 1560 | GUAGAUCUUUCUAGGAGGGmUmU | 3591 | CCCUCCUAGAAAGAUCUACmUmU |
| 1686 | 1561 | UAGAUCUUUCUAGGAGGGAmUmU | 3592 | UCCCUCCUAGAAAGAUCUAmUmU |
| 1687 | 1562 | AGAUCUUUCUAGGAGGGAGmUmU | 3593 | CUCCCUCCUAGAAAGAUCUmUmU |
| 1688 | 1563 | GAUCUUUCUAGGAGGGAGAmUmU | 3594 | UCUCCCUCCUAGAAAGAUCmUmU |
| 1689 | 1564 | AUCUUUCUAGGAGGGAGACmUmU | 3595 | GUCUCCCUCCUAGAAAGAUmUmU |
| 1690 | 1565 | UCUUUCUAGGAGGGAGACAmUmU | 3596 | UGUCUCCCUCCUAGAAAGAmUmU |
| 1691 | 1566 | CUUUCUAGGAGGGAGACACmUmU | 3597 | GUGUCUCCCUCCUAGAAAGmUmU |
| 1692 | 1567 | UUUCUAGGAGGGAGACACUmUmU | 3598 | AGUGUCUCCCUCCUAGAAAmUmU |
| 1693 | 1568 | UUCUAGGAGGGAGACACUGmUmU | 3599 | CAGUGUCUCCCUCCUAGAAmUmU |
| 1694 | 1569 | UCUAGGAGGGAGACACUGGmUmU | 3600 | CCAGUGUCUCCCUCCUAGAmUmU |
| 1695 | 1570 | CUAGGAGGGAGACACUGGCmUmU | 3601 | GCCAGUGUCUCCCUCCUAGmUmU |
| 1696 | 1571 | UAGGAGGGAGACACUGGCCmUmU | 3602 | GGCCAGUGUCUCCCUCCUAmUmU |
| 1697 | 1572 | AGGAGGGAGACACUGGCCCmUmU | 3603 | GGGCCAGUGUCUCCCUCCUmUmU |
| 1698 | 1573 | GGAGGGAGACACUGGCCCCmUmU | 3604 | GGGGCCAGUGUCUCCCUCCmUmU |
| 1699 | 1574 | GAGGGAGACACUGGCCCCUmUmU | 3605 | AGGGGCCAGUGUCUCCCUCmUmU |
| 1700 | 1575 | AGGGAGACACUGGCCCCUCmUmU | 3606 | GAGGGGCCAGUGUCUCCCUmUmU |
| 1701 | 1576 | GGGAGACACUGGCCCCUCAmUmU | 3607 | UGAGGGGCCAGUGUCUCCCmUmU |
| 1702 | 1577 | GGAGACACUGGCCCCUCAAmUmU | 3608 | UUGAGGGGCCAGUGUCUCCmUmU |
| 1703 | 1578 | GAGACACUGGCCCCUCAAAmUmU | 3609 | UUUGAGGGGCCAGUGUCUCmUmU |
| 1704 | 1579 | AGACACUGGCCCCUCAAAUmUmU | 3610 | AUUUGAGGGGCCAGUGUCUmUmU |
| 1705 | 1580 | GACACUGGCCCCUCAAAUCmUmU | 3611 | GAUUUGAGGGGCCAGUGUCmUmU |
| 1706 | 1581 | ACACUGGCCCCUCAAAUCGmUmU | 3612 | CGAUUUGAGGGGCCAGUGUmUmU |
| 1707 | 1582 | CACUGGCCCCUCAAAUCGUmUmU | 3613 | ACGAUUUGAGGGGCCAGUGmUmU |
| 1708 | 1583 | ACUGGCCCCUCAAAUCGUCmUmU | 3614 | GACGAUUUGAGGGGCCAGUmUmU |
| 1709 | 1584 | CUGGCCCCUCAAAUCGUCCmUmU | 3615 | GGACGAUUUGAGGGGCCAGmUmU |
| 1710 | 1585 | UGGCCCCUCAAAUCGUCCAmUmU | 3616 | UGGACGAUUUGAGGGGCCAmUmU |
| 1711 | 1586 | GGCCCCUCAAAUCGUCCAGmUmU | 3617 | CUGGACGAUUUGAGGGGCCmUmU |
| 1712 | 1587 | GCCCCUCAAAUCGUCCAGCmUmU | 3618 | GCUGGACGAUUUGAGGGGCmUmU |
| 1713 | 1588 | CCCCUCAAAUCGUCCAGCGmUmU | 3619 | CGCUGGACGAUUUGAGGGGmUmU |
| 1714 | 1589 | CCCUCAAAUCGUCCAGCGAmUmU | 3620 | UCGCUGGACGAUUUGAGGGmUmU |
| 1715 | 1590 | CCUCAAAUCGUCCAGCGACmUmU | 3621 | GUCGCUGGACGAUUUGAGGmUmU |
| 1716 | 1591 | CUCAAAUCGUCCAGCGACCmUmU | 3622 | GGUCGCUGGACGAUUUGAGmUmU |
| 1717 | 1592 | UCAAAUCGUCCAGCGACCUmUmU | 3623 | AGGUCGCUGGACGAUUUGAmUmU |
| 1718 | 1593 | CAAAUCGUCCAGCGACCUUmUmU | 3624 | AAGGUCGCUGGACGAUUUGmUmU |
| 1719 | 1594 | AAAUCGUCCAGCGACCUUCmUmU | 3625 | GAAGGUCGCUGGACGAUUUmUmU |
| 1720 | 1595 | AAUCGUCCAGCGACCUUCCmUmU | 3626 | GGAAGGUCGCUGGACGAUUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1721 | 1596 | AUCGUCCAGCGACCUUCCUmUmU | 3627 | AGGAAGGUCGCUGGACGAUmUmU |
| 1722 | 1597 | UCGUCCAGCGACCUUCCUCmUmU | 3628 | GAGGAAGGUCGCUGGACGAmUmU |
| 1723 | 1598 | CGUCCAGCGACCUUCCUCAmUmU | 3629 | UGAGGAAGGUCGCUGGACGmUmU |
| 1724 | 1599 | GUCCAGCGACCUUCCUCAUmUmU | 3630 | AUGAGGAAGGUCGCUGGACmUmU |
| 1725 | 1600 | UCCAGCGACCUUCCUCAUCmUmU | 3631 | GAUGAGGAAGGUCGCUGGAmUmU |
| 1726 | 1601 | CCAGCGACCUUCCUCAUCCmUmU | 3632 | GGAUGAGGAAGGUCGCUGGmUmU |
| 1727 | 1602 | CAGCGACCUUCCUCAUCCAmUmU | 3633 | UGGAUGAGGAAGGUCGCUGmUmU |
| 1728 | 1603 | AGCGACCUUCCUCAUCCACmUmU | 3634 | GUGGAUGAGGAAGGUCGCUmUmU |
| 1729 | 1604 | GCGACCUUCCUCAUCCACCmUmU | 3635 | GGUGGAUGAGGAAGGUCGCmUmU |
| 1730 | 1605 | CGACCUUCCUCAUCCACCCmUmU | 3636 | GGGUGGAUGAGGAAGGUCGmUmU |
| 1731 | 1606 | GACCUUCCUCAUCCACCCCmUmU | 3637 | GGGGUGGAUGAGGAAGGUCmUmU |
| 1732 | 1607 | ACCUUCCUCAUCCACCCCAmUmU | 3638 | UGGGGUGGAUGAGGAAGGUmUmU |
| 1733 | 1608 | CCUUCCUCAUCCACCCCAUmUmU | 3639 | AUGGGGUGGAUGAGGAAGGmUmU |
| 1734 | 1609 | CUUCCUCAUCCACCCCAUCmUmU | 3640 | GAUGGGGUGGAUGAGGAAGmUmU |
| 1735 | 1610 | UUCCUCAUCCACCCCAUCCmUmU | 3641 | GGAUGGGGUGGAUGAGGAAmUmU |
| 1736 | 1611 | UCCUCAUCCACCCCAUCCCmUmU | 3642 | GGGAUGGGGUGGAUGAGGAmUmU |
| 1737 | 1612 | CCUCAUCCACCCCAUCCCUmUmU | 3643 | AGGGAUGGGGUGGAUGAGGmUmU |
| 1738 | 1613 | CUCAUCCACCCCAUCCCUCmUmU | 3644 | GAGGGAUGGGGUGGAUGAGmUmU |
| 1739 | 1614 | UCAUCCACCCCAUCCCUCCmUmU | 3645 | GGAGGGAUGGGGUGGAUGAmUmU |
| 1740 | 1615 | CAUCCACCCCAUCCCUCCCmUmU | 3646 | GGGAGGGAUGGGGUGGAUGmUmU |
| 1741 | 1616 | AUCCACCCCAUCCCUCCCCmUmU | 3647 | GGGGAGGGAUGGGGUGGAUmUmU |
| 1742 | 1617 | UCCACCCCAUCCCUCCCCAmUmU | 3648 | UGGGGAGGGAUGGGGUGGAmUmU |
| 1743 | 1618 | CCACCCCAUCCCUCCCCAGmUmU | 3649 | CUGGGGAGGGAUGGGGUGGmUmU |
| 1744 | 1619 | CACCCCAUCCCUCCCCAGUmUmU | 3650 | ACUGGGGAGGGAUGGGGUGmUmU |
| 1745 | 1620 | ACCCCAUCCCUCCCCAGUUmUmU | 3651 | AACUGGGGAGGGAUGGGGUmUmU |
| 1746 | 1621 | CCCCAUCCCUCCCCAGUUCmUmU | 3652 | GAACUGGGGAGGGAUGGGGmUmU |
| 1747 | 1622 | CCCAUCCCUCCCCAGUUCAmUmU | 3653 | UGAACUGGGGAGGGAUGGGmUmU |
| 1748 | 1623 | CCAUCCCUCCCCAGUUCAUmUmU | 3654 | AUGAACUGGGGAGGGAUGGmUmU |
| 1749 | 1624 | CAUCCCUCCCCAGUUCAUUmUmU | 3655 | AAUGAACUGGGGAGGGAUGmUmU |
| 1750 | 1625 | AUCCCUCCCCAGUUCAUUGmUmU | 3656 | CAAUGAACUGGGGAGGGAUmUmU |
| 1751 | 1626 | UCCCUCCCCAGUUCAUUGCmUmU | 3657 | GCAAUGAACUGGGGAGGGAmUmU |
| 1752 | 1627 | CCCUCCCCAGUUCAUUGCAmUmU | 3658 | UGCAAUGAACUGGGGAGGGmUmU |
| 1753 | 1628 | CCUCCCCAGUUCAUUGCACmUmU | 3659 | GUGCAAUGAACUGGGGAGGmUmU |
| 1754 | 1629 | CUCCCCAGUUCAUUGCACUmUmU | 3660 | AGUGCAAUGAACUGGGGAGmUmU |
| 1755 | 1630 | UCCCCAGUUCAUUGCACUUmUmU | 3661 | AAGUGCAAUGAACUGGGGAmUmU |
| 1756 | 1631 | CCCCAGUUCAUUGCACUUUmUmU | 3662 | AAAGUGCAAUGAACUGGGGmUmU |
| 1757 | 1632 | CCCAGUUCAUUGCACUUUGmUmU | 3663 | CAAAGUGCAAUGAACUGGGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1758 | 1633 | CCAGUUCAUUGCACUUUGAmUmU | 3664 | UCAAAGUGCAAUGAACUGGmUmU |
| 1759 | 1634 | CAGUUCAUUGCACUUUGAUmUmU | 3665 | AUCAAAGUGCAAUGAACUGmUmU |
| 1760 | 1635 | AGUUCAUUGCACUUUGAUUmUmU | 3666 | AAUCAAAGUGCAAUGAACUmUmU |
| 1761 | 1636 | GUUCAUUGCACUUUGAUUAmUmU | 3667 | UAAUCAAAGUGCAAUGAACmUmU |
| 1762 | 1637 | UUCAUUGCACUUUGAUUAGmUmU | 3668 | CUAAUCAAAGUGCAAUGAAmUmU |
| 1763 | 1638 | UCAUUGCACUUUGAUUAGCmUmU | 3669 | GCUAAUCAAAGUGCAAUGAmUmU |
| 1764 | 1639 | CAUUGCACUUUGAUUAGCAmUmU | 3670 | UGCUAAUCAAAGUGCAAUGmUmU |
| 1765 | 1640 | AUUGCACUUUGAUUAGCAGmUmU | 3671 | CUGCUAAUCAAAGUGCAAUmUmU |
| 1766 | 1641 | UUGCACUUUGAUUAGCAGCmUmU | 3672 | GCUGCUAAUCAAAGUGCAAmUmU |
| 1767 | 1642 | UGCACUUUGAUUAGCAGCGmUmU | 3673 | CGCUGCUAAUCAAAGUGCAmUmU |
| 1768 | 1643 | GCACUUUGAUUAGCAGCGGmUmU | 3674 | CCGCUGCUAAUCAAAGUGCmUmU |
| 1769 | 1644 | CACUUUGAUUAGCAGCGGAmUmU | 3675 | UCCGCUGCUAAUCAAAGUGmUmU |
| 1770 | 1645 | ACUUUGAUUAGCAGCGGAAmUmU | 3676 | UUCCGCUGCUAAUCAAAGUmUmU |
| 1771 | 1646 | CUUUGAUUAGCAGCGGAACmUmU | 3677 | GUUCCGCUGCUAAUCAAAGmUmU |
| 1772 | 1647 | UUUGAUUAGCAGCGGAACAmUmU | 3678 | UGUUCCGCUGCUAAUCAAAmUmU |
| 1773 | 1648 | UUGAUUAGCAGCGGAACAAmUmU | 3679 | UUGUUCCGCUGCUAAUCAAmUmU |
| 1774 | 1649 | UGAUUAGCAGCGGAACAAGmUmU | 3680 | CUUGUUCCGCUGCUAAUCAmUmU |
| 1775 | 1650 | GAUUAGCAGCGGAACAAGGmUmU | 3681 | CCUUGUUCCGCUGCUAAUCmUmU |
| 1776 | 1651 | AUUAGCAGCGGAACAAGGAmUmU | 3682 | UCCUUGUUCCGCUGCUAAUmUmU |
| 1777 | 1652 | UUAGCAGCGGAACAAGGAGmUmU | 3683 | CUCCUUGUUCCGCUGCUAAmUmU |
| 1778 | 1653 | UAGCAGCGGAACAAGGAGUmUmU | 3684 | ACUCCUUGUUCCGCUGCUAmUmU |
| 1779 | 1654 | AGCAGCGGAACAAGGAGUCmUmU | 3685 | GACUCCUUGUUCCGCUGCUmUmU |
| 1780 | 1655 | GCAGCGGAACAAGGAGUCAmUmU | 3686 | UGACUCCUUGUUCCGCUGCmUmU |
| 1781 | 1656 | CAGCGGAACAAGGAGUCAGmUmU | 3687 | CUGACUCCUUGUUCCGCUGmUmU |
| 1782 | 1657 | AGCGGAACAAGGAGUCAGAmUmU | 3688 | UCUGACUCCUUGUUCCGCUmUmU |
| 1783 | 1658 | GCGGAACAAGGAGUCAGACmUmU | 3689 | GUCUGACUCCUUGUUCCGCmUmU |
| 1784 | 1659 | CGGAACAAGGAGUCAGACAmUmU | 3690 | UGUCUGACUCCUUGUUCCGmUmU |
| 1785 | 1660 | GGAACAAGGAGUCAGACAUmUmU | 3691 | AUGUCUGACUCCUUGUUCCmUmU |
| 1786 | 1661 | GAACAAGGAGUCAGACAUUmUmU | 3692 | AAUGUCUGACUCCUUGUUCmUmU |
| 1787 | 1662 | AACAAGGAGUCAGACAUUUmUmU | 3693 | AAAUGUCUGACUCCUUGUUmUmU |
| 1788 | 1663 | ACAAGGAGUCAGACAUUUUmUmU | 3694 | AAAAUGUCUGACUCCUUGUmUmU |
| 1789 | 1664 | CAAGGAGUCAGACAUUUUAmUmU | 3695 | UAAAAUGUCUGACUCCUUGmUmU |
| 1790 | 1665 | AAGGAGUCAGACAUUUUAAmUmU | 3696 | UUAAAAUGUCUGACUCCUUmUmU |
| 1791 | 1666 | AGGAGUCAGACAUUUUAAGmUmU | 3697 | CUUAAAAUGUCUGACUCCUmUmU |
| 1792 | 1667 | GGAGUCAGACAUUUUAAGAmUmU | 3698 | UCUUAAAAUGUCUGACUCCmUmU |
| 1793 | 1668 | GAGUCAGACAUUUUAAGAUmUmU | 3699 | AUCUUAAAAUGUCUGACUCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1794 | 1669 | AGUCAGACAUUUUAAGAUGmUmU | 3700 | CAUCUUAAAAUGUCUGACmUmU |
| 1795 | 1670 | GUCAGACAUUUUAAGAUGGmUmU | 3701 | CCAUCUUAAAAUGUCUGAcmUmU |
| 1796 | 1671 | UCAGACAUUUUAAGAUGGUmUmU | 3702 | ACCAUCUUAAAAUGUCUGAmUmU |
| 1797 | 1672 | CAGACAUUUUAAGAUGGUGmUmU | 3703 | CACCAUCUUAAAAUGUCUGmUmU |
| 1798 | 1673 | AGACAUUUUAAGAUGGUGGmUmU | 3704 | CCACCAUCUUAAAAUGUCmUmU |
| 1799 | 1674 | GACAUUUUAAGAUGGUGGCmUmU | 3705 | GCCACCAUCUUAAAAUGUCmUmU |
| 1800 | 1675 | ACAUUUUAAGAUGGUGGCAmUmU | 3706 | UGCCACCAUCUUAAAAUGmUmU |
| 1801 | 1676 | CAUUUUAAGAUGGUGGCAGmUmU | 3707 | CUGCCACCAUCUUAAAAUGmUmU |
| 1802 | 1677 | AUUUUAAGAUGGUGGCAGUmUmU | 3708 | ACUGCCACCAUCUUAAAAmUmU |
| 1803 | 1678 | UUUUAAGAUGGUGGCAGUAmUmU | 3709 | UACUGCCACCAUCUUAAAmUmU |
| 1804 | 1679 | UUUAAGAUGGUGGCAGUAGmUmU | 3710 | CUACUGCCACCAUCUUAAAmUmU |
| 1805 | 1680 | UUAAGAUGGUGGCAGUAGAmUmU | 3711 | UCUACUGCCACCAUCUUAmUmU |
| 1806 | 1681 | UAAGAUGGUGGCAGUAGAGmUmU | 3712 | CUCUACUGCCACCAUCUUAmUmU |
| 1807 | 1682 | AAGAUGGUGGCAGUAGAGGmUmU | 3713 | CCUCUACUGCCACCAUCUUmUmU |
| 1808 | 1683 | AGAUGGUGGCAGUAGAGGCmUmU | 3714 | GCCUCUACUGCCACCAUCmUmU |
| 1809 | 1684 | GAUGGUGGCAGUAGAGGCUmUmU | 3715 | AGCCUCUACUGCCACCAUCmUmU |
| 1810 | 1685 | AUGGUGGCAGUAGAGGCUAmUmU | 3716 | UAGCCUCUACUGCCACCAmUmU |
| 1811 | 1686 | UGGUGGCAGUAGAGGCUAUmUmU | 3717 | AUAGCCUCUACUGCCACCAmUmU |
| 1812 | 1687 | GGUGGCAGUAGAGGCUAUGmUmU | 3718 | CAUAGCCUCUACUGCCACmUmU |
| 1813 | 1688 | GUGGCAGUAGAGGCUAUGGmUmU | 3719 | CCAUAGCCUCUACUGCCAcmUmU |
| 1814 | 1689 | UGGCAGUAGAGGCUAUGGAmUmU | 3720 | UCCAUAGCCUCUACUGCCAmUmU |
| 1815 | 1690 | GGCAGUAGAGGCUAUGGACmUmU | 3721 | GUCCAUAGCCUCUACUGCCmUmU |
| 1816 | 1691 | GCAGUAGAGGCUAUGGACAmUmU | 3722 | UGUCCAUAGCCUCUACUGCmUmU |
| 1817 | 1692 | CAGUAGAGGCUAUGGACAGmUmU | 3723 | CUGUCCAUAGCCUCUACUGmUmU |
| 1818 | 1693 | AGUAGAGGCUAUGGACAGGmUmU | 3724 | CCUGUCCAUAGCCUCUACmUmU |
| 1819 | 1694 | GUAGAGGCUAUGGACAGGGmUmU | 3725 | CCCUGUCCAUAGCCUCUACmUmU |
| 1820 | 1695 | UAGAGGCUAUGGACAGGGCmUmU | 3726 | GCCCUGUCCAUAGCCUCUAmUmU |
| 1821 | 1696 | AGAGGCUAUGGACAGGGCAmUmU | 3727 | UGCCCUGUCCAUAGCCUCmUmU |
| 1822 | 1697 | GAGGCUAUGGACAGGGCAUmUmU | 3728 | AUGCCCUGUCCAUAGCCUCmUmU |
| 1823 | 1698 | AGGCUAUGGACAGGGCAUGmUmU | 3729 | CAUGCCCUGUCCAUAGCCUmUmU |
| 1824 | 1699 | GGCUAUGGACAGGGCAUGCmUmU | 3730 | GCAUGCCCUGUCCAUAGCCmUmU |
| 1825 | 1700 | GCUAUGGACAGGGCAUGCCmUmU | 3731 | GGCAUGCCCUGUCCAUAGCmUmU |
| 1826 | 1701 | CUAUGGACAGGGCAUGCCAmUmU | 3732 | UGGCAUGCCCUGUCCAUAGmUmU |
| 1827 | 1702 | UAUGGACAGGGCAUGCCACmUmU | 3733 | GUGGCAUGCCCUGUCCAUAmUmU |
| 1828 | 1703 | AUGGACAGGGCAUGCCACGmUmU | 3734 | CGUGGCAUGCCCUGUCCAUmUmU |
| 1829 | 1704 | UGGACAGGGCAUGCCACGUmUmU | 3735 | ACGUGGCAUGCCCUGUCCAmUmU |
| 1830 | 1705 | GGACAGGGCAUGCCACGUGmUmU | 3736 | CACGUGGCAUGCCCUGUCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1831 | 1706 | GACAGGGCAUGCCACGUGGmUmU | 3737 | CCACGUGGCAUGCCCUGUCmUmU |
| 1832 | 1707 | ACAGGGCAUGCCACGUGGGmUmU | 3738 | CCCACGUGGCAUGCCCUGmUmU |
| 1833 | 1708 | CAGGGCAUGCCACGUGGGCmUmU | 3739 | GCCCACGUGGCAUGCCCUGmUmU |
| 1834 | 1709 | AGGGCAUGCCACGUGGGCUmUmU | 3740 | AGCCCACGUGGCAUGCCCUmUmU |
| 1835 | 1710 | GGGCAUGCCACGUGGGCUCmUmU | 3741 | GAGCCCACGUGGCAUGCCCmUmU |
| 1836 | 1711 | GGCAUGCCACGUGGGCUCAmUmU | 3742 | UGAGCCCACGUGGCAUGCCmUmU |
| 1837 | 1712 | GCAUGCCACGUGGGCUCAUmUmU | 3743 | AUGAGCCCACGUGGCAUGCmUmU |
| 1838 | 1713 | CAUGCCACGUGGGCUCAUAmUmU | 3744 | UAUGAGCCCACGUGGCAUGmUmU |
| 1839 | 1714 | AUGCCACGUGGGCUCAUAUmUmU | 3745 | AUAUGAGCCCACGUGGCAUmUmU |
| 1840 | 1715 | UGCCACGUGGGCUCAUAUGmUmU | 3746 | CAUAUGAGCCCACGUGGCAmUmU |
| 1841 | 1716 | GCCACGUGGGCUCAUAUGGmUmU | 3747 | CCAUAUGAGCCCACGUGGCmUmU |
| 1842 | 1717 | CCACGUGGGCUCAUAUGGGmUmU | 3748 | CCCAUAUGAGCCCACGUGGmUmU |
| 1843 | 1718 | CACGUGGGCUCAUAUGGGGmUmU | 3749 | CCCCAUAUGAGCCCACGUGmUmU |
| 1844 | 1719 | ACGUGGGCUCAUAUGGGGCmUmU | 3750 | GCCCCAUAUGAGCCCACGUmUmU |
| 1845 | 1720 | CGUGGGCUCAUAUGGGGCUmUmU | 3751 | AGCCCCAUAUGAGCCCACGmUmU |
| 1846 | 1721 | GUGGGCUCAUAUGGGGCUGmUmU | 3752 | CAGCCCCAUAUGAGCCCACmUmU |
| 1847 | 1722 | UGGGCUCAUAUGGGGCUGGmUmU | 3753 | CCAGCCCCAUAUGAGCCCAmUmU |
| 1848 | 1723 | GGGCUCAUAUGGGGCUGGGmUmU | 3754 | CCCAGCCCCAUAUGAGCCCmUmU |
| 1849 | 1724 | GGCUCAUAUGGGGCUGGGAmUmU | 3755 | UCCCAGCCCCAUAUGAGCCmUmU |
| 1850 | 1725 | GCUCAUAUGGGGCUGGGAGmUmU | 3756 | CUCCCAGCCCCAUAUGAGCmUmU |
| 1851 | 1726 | CUCAUAUGGGGCUGGGAGUmUmU | 3757 | ACUCCCAGCCCCAUAUGAGmUmU |
| 1852 | 1727 | UCAUAUGGGGCUGGGAGUAmUmU | 3758 | UACUCCCAGCCCCAUAUGAmUmU |
| 1853 | 1728 | CAUAUGGGGCUGGGAGUAGmUmU | 3759 | CUACUCCCAGCCCCAUAUGmUmU |
| 1854 | 1729 | AUAUGGGGCUGGGAGUAGUmUmU | 3760 | ACUACUCCCAGCCCCAUAUmUmU |
| 1855 | 1730 | UAUGGGGCUGGGAGUAGUUmUmU | 3761 | AACUACUCCCAGCCCCAUAmUmU |
| 1856 | 1731 | AUGGGGCUGGGAGUAGUUGmUmU | 3762 | CAACUACUCCCAGCCCCAUmUmU |
| 1857 | 1732 | UGGGGCUGGGAGUAGUUGUmUmU | 3763 | ACAACUACUCCCAGCCCCAmUmU |
| 1858 | 1733 | GGGGCUGGGAGUAGUUGUCmUmU | 3764 | GACAACUACUCCCAGCCCCmUmU |
| 1859 | 1734 | GGGCUGGGAGUAGUUGUCUmUmU | 3765 | AGACAACUACUCCCAGCCCmUmU |
| 1860 | 1735 | GGCUGGGAGUAGUUGUCUUmUmU | 3766 | AAGACAACUACUCCCAGCCmUmU |
| 1861 | 1736 | GCUGGGAGUAGUUGUCUUUmUmU | 3767 | AAAGACAACUACUCCCAGCmUmU |
| 1862 | 1737 | CUGGGAGUAGUUGUCUUUCmUmU | 3768 | GAAAGACAACUACUCCCAGmUmU |
| 1863 | 1738 | UGGGAGUAGUUGUCUUUCCmUmU | 3769 | GGAAAGACAACUACUCCCAmUmU |
| 1864 | 1739 | GGGAGUAGUUGUCUUUCCUmUmU | 3770 | AGGAAAGACAACUACUCCCmUmU |
| 1865 | 1740 | GGAGUAGUUGUCUUUCCUGmUmU | 3771 | CAGGAAAGACAACUACUCCmUmU |
| 1866 | 1741 | GAGUAGUUGUCUUUCCUGGmUmU | 3772 | CCAGGAAAGACAACUACUCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1867 | 1742 | AGUAGUUGUCUUUCCUGGCmUmU | 3773 | GCCAGGAAAGACAACUACUmUmU |
| 1868 | 1743 | GUAGUUGUCUUUCCUGGCAmUmU | 3774 | UGCCAGGAAAGACAACUACmUmU |
| 1869 | 1744 | UAGUUGUCUUUCCUGGCACmUmU | 3775 | GUGCCAGGAAAGACAACUAmUmU |
| 1870 | 1745 | AGUUGUCUUUCCUGGCACUmUmU | 3776 | AGUGCCAGGAAAGACAACUmUmU |
| 1871 | 1746 | GUUGUCUUUCCUGGCACUAmUmU | 3777 | UAGUGCCAGGAAAGACAACmUmU |
| 1872 | 1747 | UUGUCUUUCCUGGCACUAAmUmU | 3778 | UUAGUGCCAGGAAAGACAAmUmU |
| 1873 | 1748 | UGUCUUUCCUGGCACUAACmUmU | 3779 | GUUAGUGCCAGGAAAGACAmUmU |
| 1874 | 1749 | GUCUUUCCUGGCACUAACGmUmU | 3780 | CGUUAGUGCCAGGAAAGACmUmU |
| 1875 | 1750 | UCUUUCCUGGCACUAACGUmUmU | 3781 | ACGUUAGUGCCAGGAAAGAmUmU |
| 1876 | 1751 | CUUUCCUGGCACUAACGUUmUmU | 3782 | AACGUUAGUGCCAGGAAAGmUmU |
| 1877 | 1752 | UUUCCUGGCACUAACGUUGmUmU | 3783 | CAACGUUAGUGCCAGGAAAmUmU |
| 1878 | 1753 | UUCCUGGCACUAACGUUGAmUmU | 3784 | UCAACGUUAGUGCCAGGAAmUmU |
| 1879 | 1754 | UCCUGGCACUAACGUUGAGmUmU | 3785 | CUCAACGUUAGUGCCAGGAmUmU |
| 1880 | 1755 | CCUGGCACUAACGUUGAGCmUmU | 3786 | GCUCAACGUUAGUGCCAGGmUmU |
| 1881 | 1756 | CUGGCACUAACGUUGAGCCmUmU | 3787 | GGCUCAACGUUAGUGCCAGmUmU |
| 1882 | 1757 | UGGCACUAACGUUGAGCCCmUmU | 3788 | GGGCUCAACGUUAGUGCCAmUmU |
| 1883 | 1758 | GGCACUAACGUUGAGCCCCmUmU | 3789 | GGGGCUCAACGUUAGUGCCmUmU |
| 1884 | 1759 | GCACUAACGUUGAGCCCCUmUmU | 3790 | AGGGGCUCAACGUUAGUGCmUmU |
| 1885 | 1760 | CACUAACGUUGAGCCCCUGmUmU | 3791 | CAGGGGCUCAACGUUAGUGmUmU |
| 1886 | 1761 | ACUAACGUUGAGCCCCUGGmUmU | 3792 | CCAGGGGCUCAACGUUAGUmUmU |
| 1887 | 1762 | CUAACGUUGAGCCCCUGGAmUmU | 3793 | UCCAGGGGCUCAACGUUAGmUmU |
| 1888 | 1763 | UAACGUUGAGCCCCUGGAGmUmU | 3794 | CUCCAGGGGCUCAACGUUAmUmU |
| 1889 | 1764 | AACGUUGAGCCCCUGGAGGmUmU | 3795 | CCUCCAGGGGCUCAACGUUmUmU |
| 1890 | 1765 | ACGUUGAGCCCCUGGAGGCmUmU | 3796 | GCCUCCAGGGGCUCAACGUmUmU |
| 1891 | 1766 | CGUUGAGCCCCUGGAGGCAmUmU | 3797 | UGCCUCCAGGGGCUCAACGmUmU |
| 1892 | 1767 | GUUGAGCCCCUGGAGGCACmUmU | 3798 | GUGCCUCCAGGGGCUCAACmUmU |
| 1893 | 1768 | UUGAGCCCCUGGAGGCACUmUmU | 3799 | AGUGCCUCCAGGGGCUCAAmUmU |
| 1894 | 1769 | UGAGCCCCUGGAGGCACUGmUmU | 3800 | CAGUGCCUCCAGGGGCUCAmUmU |
| 1895 | 1770 | GAGCCCCUGGAGGCACUGAmUmU | 3801 | UCAGUGCCUCCAGGGGCUCmUmU |
| 1896 | 1771 | AGCCCCUGGAGGCACUGAAmUmU | 3802 | UUCAGUGCCUCCAGGGGCUmUmU |
| 1897 | 1772 | GCCCCUGGAGGCACUGAAGmUmU | 3803 | CUUCAGUGCCUCCAGGGGCmUmU |
| 1898 | 1773 | CCCCUGGAGGCACUGAAGUmUmU | 3804 | ACUUCAGUGCCUCCAGGGGmUmU |
| 1899 | 1774 | CCCUGGAGGCACUGAAGUGmUmU | 3805 | CACUUCAGUGCCUCCAGGGmUmU |
| 1900 | 1775 | CCUGGAGGCACUGAAGUGCmUmU | 3806 | GCACUUCAGUGCCUCCAGGmUmU |
| 1901 | 1776 | CUGGAGGCACUGAAGUGCUmUmU | 3807 | AGCACUUCAGUGCCUCCAGmUmU |
| 1902 | 1777 | UGGAGGCACUGAAGUGCUUmUmU | 3808 | AAGCACUUCAGUGCCUCCAmUmU |
| 1903 | 1778 | GGAGGCACUGAAGUGCUUAmUmU | 3809 | UAAGCACUUCAGUGCCUCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1904 | 1779 | GAGGCACUGAAGUGCUUAGmUmU | 3810 | CUAAGCACUUCAGUGCCUCmUmU |
| 1905 | 1780 | AGGCACUGAAGUGCUUAGUmUmU | 3811 | ACUAAGCACUUCAGUGCCUmUmU |
| 1906 | 1781 | GGCACUGAAGUGCUUAGUGmUmU | 3812 | CACUAAGCACUUCAGUGCCmUmU |
| 1907 | 1782 | GCACUGAAGUGCUUAGUGUmUmU | 3813 | ACACUAAGCACUUCAGUGCmUmU |
| 1908 | 1783 | CACUGAAGUGCUUAGUGUAmUmU | 3814 | UACACUAAGCACUUCAGUGmUmU |
| 1909 | 1784 | ACUGAAGUGCUUAGUGUACmUmU | 3815 | GUACACUAAGCACUUCAGUmUmU |
| 1910 | 1785 | CUGAAGUGCUUAGUGUACUmUmU | 3816 | AGUACACUAAGCACUUCAGmUmU |
| 1911 | 1786 | UGAAGUGCUUAGUGUACUUmUmU | 3817 | AAGUACACUAAGCACUUCAmUmU |
| 1912 | 1787 | GAAGUGCUUAGUGUACUUGmUmU | 3818 | CAAGUACACUAAGCACUUCmUmU |
| 1913 | 1788 | AAGUGCUUAGUGUACUUGGmUmU | 3819 | CCAAGUACACUAAGCACUUmUmU |
| 1914 | 1789 | AGUGCUUAGUGUACUUGGAmUmU | 3820 | UCCAAGUACACUAAGCACUmUmU |
| 1915 | 1790 | GUGCUUAGUGUACUUGGAGmUmU | 3821 | CUCCAAGUACACUAAGCACmUmU |
| 1916 | 1791 | UGCUUAGUGUACUUGGAGUmUmU | 3822 | ACUCCAAGUACACUAAGCAmUmU |
| 1917 | 1792 | GCUUAGUGUACUUGGAGUAmUmU | 3823 | UACUCCAAGUACACUAAGCmUmU |
| 1918 | 1793 | CUUAGUGUACUUGGAGUAUmUmU | 3824 | AUACUCCAAGUACACUAAGmUmU |
| 1919 | 1794 | UUAGUGUACUUGGAGUAUUmUmU | 3825 | AAUACUCCAAGUACACUAAmUmU |
| 1920 | 1795 | UAGUGUACUUGGAGUAUUGmUmU | 3826 | CAAUACUCCAAGUACACUAmUmU |
| 1921 | 1796 | AGUGUACUUGGAGUAUUGGmUmU | 3827 | CCAAUACUCCAAGUACACUmUmU |
| 1922 | 1797 | GUGUACUUGGAGUAUUGGGmUmU | 3828 | CCCAAUACUCCAAGUACACmUmU |
| 1923 | 1798 | UGUACUUGGAGUAUUGGGGmUmU | 3829 | CCCCAAUACUCCAAGUACAmUmU |
| 1924 | 1799 | GUACUUGGAGUAUUGGGGUmUmU | 3830 | ACCCCAAUACUCCAAGUACmUmU |
| 1925 | 1800 | UACUUGGAGUAUUGGGGUCmUmU | 3831 | GACCCCAAUACUCCAAGUAmUmU |
| 1926 | 1801 | ACUUGGAGUAUUGGGGUCUmUmU | 3832 | AGACCCCAAUACUCCAAGUmUmU |
| 1927 | 1802 | CUUGGAGUAUUGGGGUCUGmUmU | 3833 | CAGACCCCAAUACUCCAAGmUmU |
| 1928 | 1803 | UUGGAGUAUUGGGGUCUGAmUmU | 3834 | UCAGACCCCAAUACUCCAAmUmU |
| 1929 | 1804 | UGGAGUAUUGGGGUCUGACmUmU | 3835 | GUCAGACCCCAAUACUCCAmUmU |
| 1930 | 1805 | GGAGUAUUGGGGUCUGACCmUmU | 3836 | GGUCAGACCCCAAUACUCCmUmU |
| 1931 | 1806 | GAGUAUUGGGGUCUGACCCmUmU | 3837 | GGGUCAGACCCCAAUACUCmUmU |
| 1932 | 1807 | AGUAUUGGGGUCUGACCCCmUmU | 3838 | GGGGUCAGACCCCAAUACUmUmU |
| 1933 | 1808 | GUAUUGGGGUCUGACCCCAmUmU | 3839 | UGGGGUCAGACCCCAAUACmUmU |
| 1934 | 1809 | UAUUGGGGUCUGACCCCAAmUmU | 3840 | UUGGGGUCAGACCCCAAUAmUmU |
| 1935 | 1810 | AUUGGGGUCUGACCCCAAAmUmU | 3841 | UUUGGGGUCAGACCCCAAUmUmU |
| 1936 | 1811 | UUGGGGUCUGACCCCAAACmUmU | 3842 | GUUUGGGGUCAGACCCCAAmUmU |
| 1937 | 1812 | UGGGGUCUGACCCCAAACAmUmU | 3843 | UGUUUGGGGUCAGACCCCAmUmU |
| 1938 | 1813 | GGGGUCUGACCCCAAACACmUmU | 3844 | GUGUUUGGGGUCAGACCCCmUmU |
| 1939 | 1814 | GGGUCUGACCCCAAACACCmUmU | 3845 | GGUGUUUGGGGUCAGACCCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1940 | 1815 | GGUCUGACCCCAAACACCUUmUmU | 3846 | AGGUGUUUGGGGUCAGACmUmU |
| 1941 | 1816 | GUCUGACCCCAAACACCUUCmUmU | 3847 | AAGGUGUUUGGGGUCAGACmUmU |
| 1942 | 1817 | UCUGACCCCAAACACCUUCCmUmU | 3848 | GAAGGUGUUUGGGGUCAGAmUmU |
| 1943 | 1818 | CUGACCCCAAACACCUUCCmUmU | 3849 | GGAAGGUGUUUGGGGUCAGmUmU |
| 1944 | 1819 | UGACCCCAAACACCUUCCAmUmU | 3850 | UGGAAGGUGUUUGGGGUCAmUmU |
| 1945 | 1820 | GACCCCAAACACCUUCCAGmUmU | 3851 | CUGGAAGGUGUUUGGGGUCmUmU |
| 1946 | 1821 | ACCCCAAACACCUUCCAGCmUmU | 3852 | GCUGGAAGGUGUUUGGGGUmUmU |
| 1947 | 1822 | CCCCAAACACCUUCCAGCUmUmU | 3853 | AGCUGGAAGGUGUUUGGGGmUmU |
| 1948 | 1823 | CCCAAACACCUUCCAGCUCmUmU | 3854 | GAGCUGGAAGGUGUUUGGGmUmU |
| 1949 | 1824 | CCAAACACCUUCCAGCUCCmUmU | 3855 | GGAGCUGGAAGGUGUUUGGmUmU |
| 1950 | 1825 | CAAACACCUUCCAGCUCCUmUmU | 3856 | AGGAGCUGGAAGGUGUUUGmUmU |
| 1951 | 1826 | AAACACCUUCCAGCUCCUGmUmU | 3857 | CAGGAGCUGGAAGGUGUUUmUmU |
| 1952 | 1827 | AACACCUUCCAGCUCCUGUmUmU | 3858 | ACAGGAGCUGGAAGGUGUUmUmU |
| 1953 | 1828 | ACACCUUCCAGCUCCUGUAmUmU | 3859 | UACAGGAGCUGGAAGGUGUmUmU |
| 1954 | 1829 | CACCUUCCAGCUCCUGUAAmUmU | 3860 | UUACAGGAGCUGGAAGGUGmUmU |
| 1955 | 1830 | ACCUUCCAGCUCCUGUAACmUmU | 3861 | GUUACAGGAGCUGGAAGGUmUmU |
| 1956 | 1831 | CCUUCCAGCUCCUGUAACAmUmU | 3862 | UGUUACAGGAGCUGGAAGGmUmU |
| 1957 | 1832 | CUUCCAGCUCCUGUAACAUmUmU | 3863 | AUGUUACAGGAGCUGGAAGmUmU |
| 1958 | 1833 | UUCCAGCUCCUGUAACAUAmUmU | 3864 | UAUGUUACAGGAGCUGGAAmUmU |
| 1959 | 1834 | UCCAGCUCCUGUAACAUACmUmU | 3865 | GUAUGUUACAGGAGCUGGAmUmU |
| 1960 | 1835 | CCAGCUCCUGUAACAUACUmUmU | 3866 | AGUAUGUUACAGGAGCUGGmUmU |
| 1961 | 1836 | CAGCUCCUGUAACAUACUGmUmU | 3867 | CAGUAUGUUACAGGAGCUGmUmU |
| 1962 | 1837 | AGCUCCUGUAACAUACUGGmUmU | 3868 | CCAGUAUGUUACAGGAGCUmUmU |
| 1963 | 1838 | GCUCCUGUAACAUACUGGCmUmU | 3869 | GCCAGUAUGUUACAGGAGCmUmU |
| 1964 | 1839 | CUCCUGUAACAUACUGGCCmUmU | 3870 | GGCCAGUAUGUUACAGGAGmUmU |
| 1965 | 1840 | UCCUGUAACAUACUGGCCUmUmU | 3871 | AGGCCAGUAUGUUACAGGAmUmU |
| 1966 | 1841 | CCUGUAACAUACUGGCCUGmUmU | 3872 | CAGGCCAGUAUGUUACAGGmUmU |
| 1967 | 1842 | CUGUAACAUACUGGCCUGGmUmU | 3873 | CCAGGCCAGUAUGUUACAGmUmU |
| 1968 | 1843 | UGUAACAUACUGGCCUGGAmUmU | 3874 | UCCAGGCCAGUAUGUUACAmUmU |
| 1969 | 1844 | GUAACAUACUGGCCUGGACmUmU | 3875 | GUCCAGGCCAGUAUGUUACmUmU |
| 1970 | 1845 | UAACAUACUGGCCUGGACUmUmU | 3876 | AGUCCAGGCCAGUAUGUUAmUmU |
| 1971 | 1846 | AACAUACUGGCCUGGACUGmUmU | 3877 | CAGUCCAGGCCAGUAUGUUmUmU |
| 1972 | 1847 | ACAUACUGGCCUGGACUGUmUmU | 3878 | ACAGUCCAGGCCAGUAUGUmUmU |
| 1973 | 1848 | CAUACUGGCCUGGACUGUUmUmU | 3879 | AACAGUCCAGGCCAGUAUGmUmU |
| 1974 | 1849 | AUACUGGCCUGGACUGUUUmUmU | 3880 | AAACAGUCCAGGCCAGUAUmUmU |
| 1975 | 1850 | UACUGGCCUGGACUGUUUUmUmU | 3881 | AAAACAGUCCAGGCCAGUAmUmU |
| 1976 | 1851 | ACUGGCCUGGACUGUUUUCmUmU | 3882 | GAAAACAGUCCAGGCCAGUmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 1977 | 1852 | CUGGCCUGGACUGUUUUCUmUmU | 3883 | AGAAAACAGUCCAGGCCAGmUmU |
| 1978 | 1853 | UGGCCUGGACUGUUUUCUCmUmU | 3884 | GAGAAAACAGUCCAGGCCAmUmU |
| 1979 | 1854 | GGCCUGGACUGUUUUCUCUmUmU | 3885 | AGAGAAAACAGUCCAGGCCmUmU |
| 1980 | 1855 | GCCUGGACUGUUUUCUCUCmUmU | 3886 | GAGAGAAAACAGUCCAGGCmUmU |
| 1981 | 1856 | CCUGGACUGUUUUCUCUCGmUmU | 3887 | CGAGAGAAAACAGUCCAGGmUmU |
| 1982 | 1857 | CUGGACUGUUUUCUCUCGGmUmU | 3888 | CCGAGAGAAAACAGUCCAGmUmU |
| 1983 | 1858 | UGGACUGUUUUCUCUCGGCmUmU | 3889 | GCCGAGAGAAAACAGUCCAmUmU |
| 1984 | 1859 | GGACUGUUUUCUCUCGGCUmUmU | 3890 | AGCCGAGAGAAAACAGUCCmUmU |
| 1985 | 1860 | GACUGUUUUCUCUCGGCUCmUmU | 3891 | GAGCCGAGAGAAAACAGUCmUmU |
| 1986 | 1861 | ACUGUUUUCUCUCGGCUCCmUmU | 3892 | GGAGCCGAGAGAAAACAGUmUmU |
| 1987 | 1862 | CUGUUUUCUCUCGGCUCCCmUmU | 3893 | GGGAGCCGAGAGAAAACAGmUmU |
| 1988 | 1863 | UGUUUUCUCUCGGCUCCCCmUmU | 3894 | GGGGAGCCGAGAGAAAACAmUmU |
| 1989 | 1864 | GUUUUCUCUCGGCUCCCCAmUmU | 3895 | UGGGGAGCCGAGAGAAAACmUmU |
| 1990 | 1865 | UUUUCUCUCGGCUCCCCAUmUmU | 3896 | AUGGGGAGCCGAGAGAAAAmUmU |
| 1991 | 1866 | UUUCUCUCGGCUCCCCAUGmUmU | 3897 | CAUGGGGAGCCGAGAGAAAmUmU |
| 1992 | 1867 | UUCUCUCGGCUCCCCAUGUmUmU | 3898 | ACAUGGGGAGCCGAGAGAAmUmU |
| 1993 | 1868 | UCUCUCGGCUCCCCAUGUGmUmU | 3899 | CACAUGGGGAGCCGAGAGAmUmU |
| 1994 | 1869 | CUCUCGGCUCCCCAUGUGUmUmU | 3900 | ACACAUGGGGAGCCGAGAGmUmU |
| 1995 | 1870 | UCUCGGCUCCCCAUGUGUCmUmU | 3901 | GACACAUGGGGAGCCGAGAmUmU |
| 1996 | 1871 | CUCGGCUCCCCAUGUGUCCmUmU | 3902 | GGACACAUGGGGAGCCGAGmUmU |
| 1997 | 1872 | UCGGCUCCCCAUGUGUCCUmUmU | 3903 | AGGACACAUGGGGAGCCGAmUmU |
| 1998 | 1873 | CGGCUCCCCAUGUGUCCUGmUmU | 3904 | CAGGACACAUGGGGAGCCGmUmU |
| 1999 | 1874 | GGCUCCCCAUGUGUCCUGGmUmU | 3905 | CCAGGACACAUGGGGAGCCmUmU |
| 2000 | 1875 | GCUCCCCAUGUGUCCUGGUmUmU | 3906 | ACCAGGACACAUGGGGAGCmUmU |
| 2001 | 1876 | CUCCCCAUGUGUCCUGGUUmUmU | 3907 | AACCAGGACACAUGGGGAGmUmU |
| 2002 | 1877 | UCCCCAUGUGUCCUGGUUCmUmU | 3908 | GAACCAGGACACAUGGGGAmUmU |
| 2003 | 1878 | CCCCAUGUGUCCUGGUUCCmUmU | 3909 | GGAACCAGGACACAUGGGGmUmU |
| 2004 | 1879 | CCCAUGUGUCCUGGUUCCCmUmU | 3910 | GGGAACCAGGACACAUGGGmUmU |
| 2005 | 1880 | CCAUGUGUCCUGGUUCCCGmUmU | 3911 | CGGGAACCAGGACACAUGGmUmU |
| 2006 | 1881 | CAUGUGUCCUGGUUCCCGUmUmU | 3912 | ACGGGAACCAGGACACAUGmUmU |
| 2007 | 1882 | AUGUGUCCUGGUUCCCGUUmUmU | 3913 | AACGGGAACCAGGACACAUmUmU |
| 2008 | 1883 | UGUGUCCUGGUUCCCGUUUmUmU | 3914 | AAACGGGAACCAGGACACAmUmU |
| 2009 | 1884 | GUGUCCUGGUUCCCGUUUCmUmU | 3915 | GAAACGGGAACCAGGACACmUmU |
| 2010 | 1885 | UGUCCUGGUUCCCGUUUCUmUmU | 3916 | AGAAACGGGAACCAGGACAmUmU |
| 2011 | 1886 | GUCCUGGUUCCCGUUUCUCmUmU | 3917 | GAGAAACGGGAACCAGGACmUmU |
| 2012 | 1887 | UCCUGGUUCCCGUUUCUCCmUmU | 3918 | GGAGAAACGGGAACCAGGAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 2013 | 1888 | CCUGGUUCCCGUUUCUCCAmUmU | 3919 | UGGAGAAACGGGAACCAGGmUmU |
| 2014 | 1889 | CUGGUUCCCGUUUCUCCACmUmU | 3920 | GUGGAGAAACGGGAACCAGmUmU |
| 2015 | 1890 | UGGUUCCCGUUUCUCCACCmUmU | 3921 | GGUGGAGAAACGGGAACCAmUmU |
| 2016 | 1891 | GGUUCCCGUUUCUCCACCUmUmU | 3922 | AGGUGGAGAAACGGGAACCmUmU |
| 2017 | 1892 | GUUCCCGUUUCUCCACCUAmUmU | 3923 | UAGGUGGAGAAACGGGAACmUmU |
| 2018 | 1893 | UUCCCGUUUCUCCACCUAGmUmU | 3924 | CUAGGUGGAGAAACGGGAAmUmU |
| 2019 | 1894 | UCCCGUUUCUCCACCUAGAmUmU | 3925 | UCUAGGUGGAGAAACGGGAmUmU |
| 2020 | 1895 | CCCGUUUCUCCACCUAGACmUmU | 3926 | GUCUAGGUGGAGAAACGGGmUmU |
| 2021 | 1896 | CCGUUUCUCCACCUAGACUmUmU | 3927 | AGUCUAGGUGGAGAAACGGmUmU |
| 2022 | 1897 | CGUUUCUCCACCUAGACUGmUmU | 3928 | CAGUCUAGGUGGAGAAACGmUmU |
| 2023 | 1898 | GUUUCUCCACCUAGACUGUmUmU | 3929 | ACAGUCUAGGUGGAGAAACmUmU |
| 2024 | 1899 | UUUCUCCACCUAGACUGUAmUmU | 3930 | UACAGUCUAGGUGGAGAAAmUmU |
| 2025 | 1900 | UUCUCCACCUAGACUGUAAmUmU | 3931 | UUACAGUCUAGGUGGAGAAmUmU |
| 2026 | 1901 | UCUCCACCUAGACUGUAAAmUmU | 3932 | UUUACAGUCUAGGUGGAGAmUmU |
| 2027 | 1902 | CUCCACCUAGACUGUAAACmUmU | 3933 | GUUUACAGUCUAGGUGGAGmUmU |
| 2028 | 1903 | UCCACCUAGACUGUAAACCmUmU | 3934 | GGUUUACAGUCUAGGUGGAmUmU |
| 2029 | 1904 | CCACCUAGACUGUAAACCUmUmU | 3935 | AGGUUUACAGUCUAGGUGGmUmU |
| 2030 | 1905 | CACCUAGACUGUAAACCUCmUmU | 3936 | GAGGUUUACAGUCUAGGUGmUmU |
| 2031 | 1906 | ACCUAGACUGUAAACCUCUmUmU | 3937 | AGAGGUUUACAGUCUAGGUmUmU |
| 2032 | 1907 | CCUAGACUGUAAACCUCUCmUmU | 3938 | GAGAGGUUUACAGUCUAGGmUmU |
| 2033 | 1908 | CUAGACUGUAAACCUCUCGmUmU | 3939 | CGAGAGGUUUACAGUCUAGmUmU |
| 2034 | 1909 | UAGACUGUAAACCUCUCGAmUmU | 3940 | UCGAGAGGUUUACAGUCUAmUmU |
| 2035 | 1910 | AGACUGUAAACCUCUCGAGmUmU | 3941 | CUCGAGAGGUUUACAGUCUmUmU |
| 2036 | 1911 | GACUGUAAACCUCUCGAGGmUmU | 3942 | CCUCGAGAGGUUUACAGUCmUmU |
| 2037 | 1912 | ACUGUAAACCUCUCGAGGGmUmU | 3943 | CCCUCGAGAGGUUUACAGUmUmU |
| 2038 | 1913 | CUGUAAACCUCUCGAGGGCmUmU | 3944 | GCCCUCGAGAGGUUUACAGmUmU |
| 2039 | 1914 | UGUAAACCUCUCGAGGGCAmUmU | 3945 | UGCCCUCGAGAGGUUUACAmUmU |
| 2040 | 1915 | GUAAACCUCUCGAGGGCAGmUmU | 3946 | CUGCCCUCGAGAGGUUUACmUmU |
| 2041 | 1916 | UAAACCUCUCGAGGGCAGGmUmU | 3947 | CCUGCCCUCGAGAGGUUUAmUmU |
| 2042 | 1917 | AAACCUCUCGAGGGCAGGGmUmU | 3948 | CCCUGCCCUCGAGAGGUUUmUmU |
| 2043 | 1918 | AACCUCUCGAGGGCAGGGAmUmU | 3949 | UCCCUGCCCUCGAGAGGUUmUmU |
| 2044 | 1919 | ACCUCUCGAGGGCAGGGACmUmU | 3950 | GUCCCUGCCCUCGAGAGGUmUmU |
| 2045 | 1920 | CCUCUCGAGGGCAGGGACCmUmU | 3951 | GGUCCCUGCCCUCGAGAGGmUmU |
| 2046 | 1921 | CUCUCGAGGGCAGGGACCAmUmU | 3952 | UGGUCCCUGCCCUCGAGAGmUmU |
| 2047 | 1922 | UCUCGAGGGCAGGGACCACmUmU | 3953 | GUGGUCCCUGCCCUCGAGAmUmU |
| 2048 | 1923 | CUCGAGGGCAGGGACCACAmUmU | 3954 | UGUGGUCCCUGCCCUCGAGmUmU |
| 2049 | 1924 | UCGAGGGCAGGGACCACACmUmU | 3955 | GUGUGGUCCCUGCCCUCGAmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 2050 | 1925 | CGAGGGCAGGGACCACACCmUmU | 3956 | GGUGUGGUCCCUGCCCUCGmUmU |
| 2051 | 1926 | GAGGGCAGGGACCACACCCmUmU | 3957 | GGGUGUGGUCCCUGCCCUCmUmU |
| 2052 | 1927 | AGGGCAGGGACCACACCCUmUmU | 3958 | AGGGUGUGGUCCCUGCCCUmUmU |
| 2053 | 1928 | GGGCAGGGACCACACCCUGmUmU | 3959 | CAGGGUGUGGUCCCUGCCCmUmU |
| 2054 | 1929 | GGCAGGGACCACACCCUGUmUmU | 3960 | ACAGGGUGUGGUCCCUGCCmUmU |
| 2055 | 1930 | GCAGGGACCACACCCUGUAmUmU | 3961 | UACAGGGUGUGGUCCCUGCmUmU |
| 2056 | 1931 | CAGGGACCACACCCUGUACmUmU | 3962 | GUACAGGGUGUGGUCCCUGmUmU |
| 2057 | 1932 | AGGGACCACACCCUGUACUmUmU | 3963 | AGUACAGGGUGUGGUCCCUmUmU |
| 2058 | 1933 | GGGACCACACCCUGUACUGmUmU | 3964 | CAGUACAGGGUGUGGUCCCmUmU |
| 2059 | 1934 | GGACCACACCCUGUACUGUmUmU | 3965 | ACAGUACAGGGUGUGGUCCmUmU |
| 2060 | 1935 | GACCACACCCUGUACUGUUmUmU | 3966 | AACAGUACAGGGUGUGGUCmUmU |
| 2061 | 1936 | ACCACACCCUGUACUGUUCmUmU | 3967 | GAACAGUACAGGGUGUGGUmUmU |
| 2062 | 1937 | CCACACCCUGUACUGUUCUmUmU | 3968 | AGAACAGUACAGGGUGUGGmUmU |
| 2063 | 1938 | CACACCCUGUACUGUUCUGmUmU | 3969 | CAGAACAGUACAGGGUGUGmUmU |
| 2064 | 1939 | ACACCCUGUACUGUUCUGUmUmU | 3970 | ACAGAACAGUACAGGGUGUmUmU |
| 2065 | 1940 | CACCCUGUACUGUUCUGUGmUmU | 3971 | CACAGAACAGUACAGGGUGmUmU |
| 2066 | 1941 | ACCCUGUACUGUUCUGUGUmUmU | 3972 | ACACAGAACAGUACAGGGUmUmU |
| 2067 | 1942 | CCCUGUACUGUUCUGUGUCmUmU | 3973 | GACACAGAACAGUACAGGGmUmU |
| 2068 | 1943 | CCUGUACUGUUCUGUGUCUmUmU | 3974 | AGACACAGAACAGUACAGGmUmU |
| 2069 | 1944 | CUGUACUGUUCUGUGUCUUmUmU | 3975 | AAGACACAGAACAGUACAGmUmU |
| 2070 | 1945 | UGUACUGUUCUGUGUCUUUmUmU | 3976 | AAAGACACAGAACAGUACAmUmU |
| 2071 | 1946 | GUACUGUUCUGUGUCUUUCmUmU | 3977 | GAAAGACACAGAACAGUACmUmU |
| 2072 | 1947 | UACUGUUCUGUGUCUUUCAmUmU | 3978 | UGAAAGACACAGAACAGUAmUmU |
| 2073 | 1948 | ACUGUUCUGUGUCUUUCACmUmU | 3979 | GUGAAAGACACAGAACAGUmUmU |
| 2074 | 1949 | CUGUUCUGUGUCUUUCACAmUmU | 3980 | UGUGAAAGACACAGAACAGmUmU |
| 2075 | 1950 | UGUUCUGUGUCUUUCACAGmUmU | 3981 | CUGUGAAAGACACAGAACAmUmU |
| 2076 | 1951 | GUUCUGUGUCUUUCACAGCmUmU | 3982 | GCUGUGAAAGACACAGAACmUmU |
| 2077 | 1952 | UUCUGUGUCUUUCACAGCUmUmU | 3983 | AGCUGUGAAAGACACAGAAmUmU |
| 2078 | 1953 | UCUGUGUCUUUCACAGCUCmUmU | 3984 | GAGCUGUGAAAGACACAGAmUmU |
| 2079 | 1954 | CUGUGUCUUUCACAGCUCCmUmU | 3985 | GGAGCUGUGAAAGACACAGmUmU |
| 2080 | 1955 | UGUGUCUUUCACAGCUCCUmUmU | 3986 | AGGAGCUGUGAAAGACACAmUmU |
| 2081 | 1956 | GUGUCUUUCACAGCUCCUCmUmU | 3987 | GAGGAGCUGUGAAAGACACmUmU |
| 2082 | 1957 | UGUCUUUCACAGCUCCUCCmUmU | 3988 | GGAGGAGCUGUGAAAGACAmUmU |
| 2083 | 1958 | GUCUUUCACAGCUCCUCCCmUmU | 3989 | GGGAGGAGCUGUGAAAGACmUmU |
| 2084 | 1959 | UCUUUCACAGCUCCUCCCAmUmU | 3990 | UGGGAGGAGCUGUGAAAGAmUmU |
| 2085 | 1960 | CUUUCACAGCUCCUCCCACmUmU | 3991 | GUGGGAGGAGCUGUGAAAGmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 2086 | 1961 | UUUCACAGCUCCUCCCACAmUmU | 3992 | UGUGGGAGGAGCUGUGAAAmUmU |
| 2087 | 1962 | UUCACAGCUCCUCCCACAAmUmU | 3993 | UUGUGGGAGGAGCUGUGAAmUmU |
| 2088 | 1963 | UCACAGCUCCUCCCACAAUmUmU | 3994 | AUUGUGGGAGGAGCUGUGAmUmU |
| 2089 | 1964 | CACAGCUCCUCCCACAAUGmUmU | 3995 | CAUUGUGGGAGGAGCUGUGmUmU |
| 2090 | 1965 | ACAGCUCCUCCCACAAUGCmUmU | 3996 | GCAUUGUGGGAGGAGCUGUmUmU |
| 2091 | 1966 | CAGCUCCUCCCACAAUGCUmUmU | 3997 | AGCAUUGUGGGAGGAGCUGmUmU |
| 2092 | 1967 | AGCUCCUCCCACAAUGCUGmUmU | 3998 | CAGCAUUGUGGGAGGAGCUmUmU |
| 2093 | 1968 | GCUCCUCCCACAAUGCUGAmUmU | 3999 | UCAGCAUUGUGGGAGGAGCmUmU |
| 2094 | 1969 | CUCCUCCCACAAUGCUGAAmUmU | 4000 | UUCAGCAUUGUGGGAGGAGmUmU |
| 2095 | 1970 | UCCUCCCACAAUGCUGAAUmUmU | 4001 | AUUCAGCAUUGUGGGAGGAmUmU |
| 2096 | 1971 | CCUCCCACAAUGCUGAAUAmUmU | 4002 | UAUUCAGCAUUGUGGGAGGmUmU |
| 2097 | 1972 | CUCCCACAAUGCUGAAUAUmUmU | 4003 | AUAUUCAGCAUUGUGGGAGmUmU |
| 2098 | 1973 | UCCCACAAUGCUGAAUAUAmUmU | 4004 | UAUAUUCAGCAUUGUGGGAmUmU |
| 2099 | 1974 | CCCACAAUGCUGAAUAUACmUmU | 4005 | GUAUAUUCAGCAUUGUGGGmUmU |
| 2100 | 1975 | CCACAAUGCUGAAUAUACAmUmU | 4006 | UGUAUAUUCAGCAUUGUGGmUmU |
| 2101 | 1976 | CACAAUGCUGAAUAUACAGmUmU | 4007 | CUGUAUAUUCAGCAUUGUGmUmU |
| 2102 | 1977 | ACAAUGCUGAAUAUACAGCmUmU | 4008 | GCUGUAUAUUCAGCAUUGUmUmU |
| 2103 | 1978 | CAAUGCUGAAUAUACAGCAmUmU | 4009 | UGCUGUAUAUUCAGCAUUGmUmU |
| 2104 | 1979 | AAUGCUGAAUAUACAGCAGmUmU | 4010 | CUGCUGUAUAUUCAGCAUUmUmU |
| 2105 | 1980 | AUGCUGAAUAUACAGCAGGmUmU | 4011 | CCUGCUGUAUAUUCAGCAUmUmU |
| 2106 | 1981 | UGCUGAAUAUACAGCAGGUmUmU | 4012 | ACCUGCUGUAUAUUCAGCAmUmU |
| 2107 | 1982 | GCUGAAUAUACAGCAGGUGmUmU | 4013 | CACCUGCUGUAUAUUCAGCmUmU |
| 2108 | 1983 | CUGAAUAUACAGCAGGUGCmUmU | 4014 | GCACCUGCUGUAUAUUCAGmUmU |
| 2109 | 1984 | UGAAUAUACAGCAGGUGCUmUmU | 4015 | AGCACCUGCUGUAUAUUCAmUmU |
| 2110 | 1985 | GAAUAUACAGCAGGUGCUCmUmU | 4016 | GAGCACCUGCUGUAUAUUCmUmU |
| 2111 | 1986 | AAUAUACAGCAGGUGCUCAmUmU | 4017 | UGAGCACCUGCUGUAUAUUmUmU |
| 2112 | 1987 | AUAUACAGCAGGUGCUCAAmUmU | 4018 | UUGAGCACCUGCUGUAUAUmUmU |
| 2113 | 1988 | UAUACAGCAGGUGCUCAAUmUmU | 4019 | AUUGAGCACCUGCUGUAUAmUmU |
| 2114 | 1989 | AUACAGCAGGUGCUCAAUAmUmU | 4020 | UAUUGAGCACCUGCUGUAUmUmU |
| 2115 | 1990 | UACAGCAGGUGCUCAAUAAmUmU | 4021 | UUAUUGAGCACCUGCUGUAmUmU |
| 2116 | 1991 | ACAGCAGGUGCUCAAUAAAmUmU | 4022 | UUUAUUGAGCACCUGCUGUmUmU |
| 2117 | 1992 | CAGCAGGUGCUCAAUAAAUmUmU | 4023 | AUUUAUUGAGCACCUGCUGmUmU |
| 2118 | 1993 | AGCAGGUGCUCAAUAAAUGmUmU | 4024 | CAUUUAUUGAGCACCUGCUmUmU |
| 2119 | 1994 | GCAGGUGCUCAAUAAAUGAmUmU | 4025 | UCAUUUAUUGAGCACCUGCmUmU |
| 2120 | 1995 | CAGGUGCUCAAUAAAUGAUmUmU | 4026 | AUCAUUUAUUGAGCACCUGmUmU |
| 2121 | 1996 | AGGUGCUCAAUAAAUGAUUmUmU | 4027 | AAUCAUUUAUUGAGCACCUmUmU |
| 2122 | 1997 | GGUGCUCAAUAAAUGAUUCmUmU | 4028 | GAAUCAUUUAUUGAGCACCmUmU |

TABLE 1-continued

RNAi molecule sequences for p21

| Ref Pos | SEQ ID NO | SENSE STRAND (5'-->3') SEQ ID NOS: 2 to 2032 | SEQ ID NO | ANTISENSE STRAND (5'-->3') SEQ ID NOS: 2033 to 4063 |
|---|---|---|---|---|
| 2123 | 1998 | GUGCUCAAUAAAUGAUUCUmUmU | 4029 | AGAAUCAUUUAUUGAGCACmUmU |
| 2124 | 1999 | UGCUCAAUAAAUGAUUCUUmUmU | 4030 | AAGAAUCAUUUAUUGAGCAmUmU |
| 2125 | 2000 | GCUCAAUAAAUGAUUCUUAmUmU | 4031 | UAAGAAUCAUUUAUUGAGCmUmU |
| 2126 | 2001 | CUCAAUAAAUGAUUCUUAGmUmU | 4032 | CUAAGAAUCAUUUAUUGAGmUmU |
| 2127 | 2002 | UCAAUAAAUGAUUCUUAGUmUmU | 4033 | ACUAAGAAUCAUUUAUUGAmUmU |
| 2128 | 2003 | CAAUAAAUGAUUCUUAGUGmUmU | 4034 | CACUAAGAAUCAUUUAUUGmUmU |
| 2129 | 2004 | AAUAAAUGAUUCUUAGUGAmUmU | 4035 | UCACUAAGAAUCAUUUAUmUmU |
| 2130 | 2005 | AUAAAUGAUUCUUAGUGACmUmU | 4036 | GUCACUAAGAAUCAUUUAmUmU |
| 2131 | 2006 | UAAAUGAUUCUUAGUGACUmUmU | 4037 | AGUCACUAAGAAUCAUUUAmUmU |
| 2132 | 2007 | AAAUGAUUCUUAGUGACUUmUmU | 4038 | AAGUCACUAAGAAUCAUUUmUmU |
| 2133 | 2008 | AAUGAUUCUUAGUGACUUUmUmU | 4039 | AAAGUCACUAAGAAUCAUmUmU |
| 2134 | 2009 | AUGAUUCUUAGUGACUUUAmUmU | 4040 | UAAAGUCACUAAGAAUCAmUmU |
| 2135 | 2010 | UGAUUCUUAGUGACUUUACmUmU | 4041 | GUAAAGUCACUAAGAAUCAmUmU |
| 2136 | 2011 | GAUUCUUAGUGACUUUACUmUmU | 4042 | AGUAAAGUCACUAAGAAUCmUmU |
| 2137 | 2012 | AUUCUUAGUGACUUUACUUmUmU | 4043 | AAGUAAAGUCACUAAGAAUmUmU |
| 2138 | 2013 | UUCUUAGUGACUUUACUUGmUmU | 4044 | CAAGUAAAGUCACUAAGAAmUmU |
| 2139 | 2014 | UCUUAGUGACUUUACUUGUmUmU | 4045 | ACAAGUAAAGUCACUAAGAmUmU |
| 2140 | 2015 | CUUAGUGACUUUACUUGUAmUmU | 4046 | UACAAGUAAAGUCACUAAGmUmU |
| 2141 | 2016 | UUAGUGACUUUACUUGUAAmUmU | 4047 | UUACAAGUAAAGUCACUAAmUmU |
| 2142 | 2017 | UAGUGACUUUACUUGUAAAmUmU | 4048 | UUUACAAGUAAAGUCACUAmUmU |
| 2143 | 2018 | AGUGACUUUACUUGUAAAAmUmU | 4049 | UUUUACAAGUAAAGUCACUmUmU |
| 2144 | 2019 | GUGACUUUACUUGUAAAAAmUmU | 4050 | UUUUUACAAGUAAAGUCACmUmU |
| 2145 | 2020 | UGACUUUACUUGUAAAAAAmUmU | 4051 | UUUUUUACAAGUAAAGUCAmUmU |
| 2146 | 2021 | GACUUUACUUGUAAAAAAAmUmU | 4052 | UUUUUUUACAAGUAAAGUCmUmU |
| 2147 | 2022 | ACUUUACUUGUAAAAAAAAmUmU | 4053 | UUUUUUUUACAAGUAAAGUmUmU |
| 2148 | 2023 | CUUUACUUGUAAAAAAAAAmUmU | 4054 | UUUUUUUUUACAAGUAAAGmUmU |
| 2149 | 2024 | UUUACUUGUAAAAAAAAAAmUmU | 4055 | UUUUUUUUUUACAAGUAAAmUmU |
| 2150 | 2025 | UUACUUGUAAAAAAAAAAAmUmU | 4056 | UUUUUUUUUUUACAAGUAAmUmU |
| 2151 | 2026 | UACUUGUAAAAAAAAAAAAmUmU | 4057 | UUUUUUUUUUUUACAAGUAmUmU |
| 2152 | 2027 | ACUUGUAAAAAAAAAAAAAmUmU | 4058 | UUUUUUUUUUUUUACAAGUmUmU |
| 2153 | 2028 | CUUGUAAAAAAAAAAAAAAmUmU | 4059 | UUUUUUUUUUUUUUACAAGmUmU |
| 2154 | 2029 | UUGUAAAAAAAAAAAAAAAmUmU | 4060 | UUUUUUUUUUUUUUUACAAmUmU |
| 2155 | 2030 | UGUAAAAAAAAAAAAAAAAmUmU | 4061 | UUUUUUUUUUUUUUUUACmUmU |
| 2156 | 2031 | GUAAAAAAAAAAAAAAAAAmUmU | 4062 | UUUUUUUUUUUUUUUUUACmUmU |
| 2157 | 2032 | UAAAAAAAAAAAAAAAAAAmUmU | 4063 | UUUUUUUUUUUUUUUUUUUAmUmU |

Key for Table 1: Upper case A, G, C and U referred to for ribo-A, ribo-G, ribo-C and ribo-U respectively. The lower case letters a, g, c, t represent 2'-deoxy-A, 2'-deoxy-G, 2'-deoxy-C and thymidine respectively. mU is 2'-methoxy-U.

TABLE 2

RNAi molecule sequences for p21

| Ref ID | Pos | SEQ ID NO 4064 to 4091 | SENSE STRAND SEQ (5'-->3') SEQ ID NOS: | SEQ ID NO 4092 to 4119 | ANTISENSE STRAND SEQ (5'-->3') SEQ ID NOS: |
|---|---|---|---|---|---|
| 1 | 2085 | 4064 | CUUAGUGACUUUACUUGUAmUmU | 4092 | UACAAGUAAAGUCACUAAGmUmU |
| 2 | 500 | 4065 | CAGACCAGCAUGACAGAUUmUmU | 4093 | AAUCUGUCAUGCUGGUCUGmUmU |
| 3 | 540 | 4066 | UGAUCUUCUCCAAGAGGAAmUmU | 4094 | UUCCUCUUGGAGAAGAUCAmUmU |
| 4 | 1706 | 4067 | GUUCAUUGCACUUUGAUUAmUmU | 4095 | UAAUCAAAGUGCAAUGAACmUmU |
| 5 | 1709 | 4068 | CAUUGCACUUUGAUUAGCAmUmU | 4096 | UGCUAAUCAAAGUGCAAUGmUmU |
| 6 | 210 | 4069 | AGCGAUGGAACUUCGACUUmUmU | 4097 | AAGUCGAAGUUCCAUCGCUmUmU |
| 7 | 211 | 4070 | GCGAUGGAACUUCGACUUUmUmU | 4098 | AAAGUCGAAGUUCCAUCGCmUmU |
| 8 | 1473 | 4071 | GGGAAGGGACACACAAGAAmUmU | 4099 | UUCUUGUGUGUCCCUUCCCmUmU |
| 9 | 1507 | 4072 | UCUACCUCAGGCAGCUCAAmUmU | 4100 | UUGAGCUGCCUGAGGUAGAmUmU |
| 10 | 2067 | 4073 | GGUGCUCAAUAAAUGAUUCmUmU | 4101 | GAAUCAUUUAUUGAGCACCmUmU |
| 11 | 1063 | 4074 | CAUCAUCAAAAACUUUGGAmUmU | 4102 | UCCAAAGUUUUUGAUGAUGmUmU |
| 12 | 1735 | 4075 | AAGGAGUCAGACAUUUUAAmUmU | 4103 | UUAAAAUGUCUGACUCCUUmUmU |
| 13 | 783 | 4076 | GUGCUGGGCAUUUUUAUUUmUmU | 4104 | AAAUAAAAAUGCCCAGCACmUmU |
| 14 | 869 | 4077 | GCCGGCUUCAUGCCAGCUAmUmU | 4105 | UAGCUGGCAUGAAGCCGGCmUmU |
| 15 | 1060 | 4078 | GGGCAUCAUCAAAAACUUUmUmU | 4106 | AAAGUUUUUGAUGAUGCCCmUmU |
| 16 | 1492 | 4079 | GAAGGGCACCCUAGUUCUAmUmU | 4107 | UAGAACUAGGGUGCCCUUCmUmU |
| 17 | 1704 | 4080 | CAGUUCAUUGCACUUUGAUmUmU | 4108 | AUCAAAGUGCAAUGAACUGmUmU |
| 18 | 1733 | 4081 | ACAAGGAGUCAGACAUUUUmUmU | 4109 | AAAAUGUCUGACUCCUUGUmUmU |
| 19 | 1847 | 4082 | UGGAGGCACUGAAGUGCUUmUmU | 4110 | AAGCACUUCAGUGCCUCCAmUmU |
| 20 | 2000 | 4083 | GCAGGGACCACACCCUGUAmUmU | 4111 | UACAGGGUGUGGUCCCUGCmUmU |
| 21 | 2014 | 4084 | CUGUACUGUUCUGUGUCUUmUmU | 4112 | AAGACACAGAACAGUACAGmUmU |
| 22 | 677 | 4085 | UUAAACACCUCCUCAUGUAmUmU | 4113 | UACAUGAGGAGGUGUUUAAmUmU |
| 23 | 475 | 4086 | AGACUCUCAGGGUCGAAAAmUmU | 4114 | UUUUCGACCCUGAGAGUCUmUmU |
| 24 | 508 | 4087 | CAUGACAGAUUUCUACCACmUmU | 4115 | GUGGUAGAAAUCUGUCAUGmUmU |
| 25 | 514 | 4088 | AGAUUUCUACCACUCCAAAmUmU | 4116 | UUUGGAGUGGUAGAAAUCUmUmU |
| 26 | 549 | 4089 | CCAAGAGGAAGCCCUAAUCmUmU | 4117 | GAUUAGGGCUUCCUCUUGGmUmU |
| 27 | 382 | 4090 | GACAGCAGAGGAAGACCAUmUmU | 4118 | AUGGUCUUCCUCUGCUGUCmUmU |
| 28 | 2042 | 4091 | CUCCCACAAUGCUGAAUAUmUmU | 4119 | AUAUUCAGCAUUGUGGGAGmUmU |

Key for Table 2: Upper case A, G, C and U referred to for ribo-A, ribo-G, ribo-C and ribo-U respectively. The lower case letters a, g, c, t represent 2'-deoxy-A, 2'-deoxy-G, 2'-deoxy-C and thymidine respectively. mU is 2'-methoxy-U.

For example, a siRNA of this invention may have an antisense strand which is SEQ ID NO:4103, and a sense strand which is SEQ ID NO:4075, or chemically modified strands thereof.

For example, a siRNA of this invention may have an antisense strand which is SEQ ID NO:4119, and a sense strand which is SEQ ID NO:4091, or chemically modified strands thereof.

Chemical modifications may comprise a 2'-OMe substituent group on any nucleotide in any position in a strand, as well as other modifications known in the art.

Methods for Modulating p21 and Treating Malignant Tumor

Embodiments of this invention can provide RNAi molecules that can be used to down regulate or inhibit the expression of p21 and/or p21 proteins.

In some embodiments, a RNAi molecule of this invention can be used to down regulate or inhibit the expression of CDKN1A and/or p21 proteins arising from CDKN1A haplotype polymorphisms that may be associated with a disease or condition such as malignant tumor.

Monitoring of p21 protein or mRNA levels can be used to characterize gene silencing, and to determine the efficacy of compounds and compositions of this invention.

The RNAi molecules of this disclosure can be used individually, or in combination with other siRNAs for modulating the expression of one or more genes.

The RNAi molecules of this disclosure can be used individually, or in combination, or in conjunction with other known drugs for preventing or treating diseases, or ameliorating symptoms of conditions or disorders associated with p21, including malignant tumor.

The RNAi molecules of this invention can be used to modulate or inhibit the expression of p21 in a sequence-specific manner.

The RNAi molecules of this disclosure can include a guide strand for which a series of contiguous nucleotides are at least partially complementary to a p21 mRNA.

In certain aspects, malignant tumor may be treated by RNA interference using a RNAi molecule of this invention.

Treatment of malignant tumor may be characterized in suitable cell-based models, as well as ex vivo or in vivo animal models.

Treatment of malignant tumor may be characterized by determining the level of p21 mRNA or the level of p21 protein in cells of affected tissue.

Treatment of malignant tumor may be characterized by non-invasive medical scanning of an affected organ or tissue.

Embodiments of this invention may include methods for preventing, treating, or ameliorating the symptoms of a p21 associated disease or condition in a subject in need thereof.

In some embodiments, methods for preventing, treating, or ameliorating the symptoms of malignant tumor in a subject can include administering to the subject a RNAi molecule of this invention to modulate the expression of a CDKN1A gene (p21) in the subject or organism.

In some embodiments, this invention contemplates methods for down regulating the expression of a CDKN1A gene (p21) in a cell or organism, by contacting the cell or organism with a RNAi molecule of this invention.

RNA Interference

RNA interference (RNAi) refers to sequence-specific post-transcriptional gene silencing in animals mediated by short interfering RNAs (siRNAs). See, e.g., Zamore et al., Cell, 2000, Vol. 101, pp. 25-33; Fire et al., Nature, 1998, Vol. 391, pp. 806811; Sharp, Genes & Development, 1999, Vol. 13, pp. 139-141.

An RNAi response in cells can be triggered by a double stranded RNA (dsRNA), although the mechanism is not yet fully understood. Certain dsRNAs in cells can undergo the action of Dicer enzyme, a ribonuclease III enzyme. See, e.g., Zamore et al., Cell, 2000, Vol. 101, pp. 25-33; Hammond et al., Nature, 2000, Vol. 404, pp. 293-296. Dicer can process the dsRNA into shorter pieces of dsRNA, which are siRNAs.

In general, siRNAs can be from about 21 to about 23 nucleotides in length and include a base pair duplex region about 19 nucleotides in length.

RNAi involves an endonuclease complex known as the RNA induced silencing complex (RISC). An siRNA has an antisense or guide strand which enters the RISC complex and mediates cleavage of a single stranded RNA target having a sequence complementary to the antisense strand of the siRNA duplex. The other strand of the siRNA is the passenger strand. Cleavage of the target RNA takes place in the middle of the region complementary to the antisense strand of the siRNA duplex See, e.g., Elbashir et al., Genes & Development, 2001, Vol. 15, pp. 188-200.

As used herein, the term "sense strand" refers to a nucleotide sequence of a siRNA molecule that is partially or fully complementary to at least a portion of a corresponding antisense strand of the siRNA molecule. The sense strand of a siRNA molecule can include a nucleic acid sequence having homology with a target nucleic acid sequence.

As used herein, the term "antisense strand" refers to a nucleotide sequence of a siRNA molecule that is partially or fully complementary to at least a portion of a target nucleic acid sequence. The antisense strand of a siRNA molecule can include a nucleic acid sequence that is complementary to at least a portion of a corresponding sense strand of the siRNA molecule.

RNAi molecules can down regulate or knock down gene expression by mediating RNA interference in a sequence-specific manner. See, e.g., Zamore et al., Cell, 2000, Vol. 101, pp. 25-33; Elbashir et al., Nature, 2001, Vol. 411, pp. 494-498; Kreutzer et al., WO2000/044895; Zernicka-Goetz et al., WO2001/36646; Fire et al., WO1999/032619; Plaetinck et al., WO2000/01846; Mello et al., WO2001/029058.

As used herein, the terms "inhibit," "down-regulate," or "reduce" with respect to gene expression means that the expression of the gene, or the level of mRNA molecules encoding one or more proteins, or the activity of one or more of the encoded proteins is reduced below that observed in the absence of a RNAi molecule or siRNA of this invention. For example, the level of expression, level of mRNA, or level of encoded protein activity may be reduced by at least 1%, or at least 10%, or at least 20%, or at least 50%, or at least 90%, or more from that observed in the absence of a RNAi molecule or siRNA of this invention.

RNAi molecules can also be used to knock down viral gene expression, and therefore affect viral replication.

RNAi molecules can be made from separate polynucleotide strands: a sense strand or passenger strand, and an antisense strand or guide strand. The guide and passenger strands are at least partially complementary. The guide strand and passenger strand can form a duplex region having from about 15 to about 49 base pairs.

In some embodiments, the duplex region of a siRNA can have 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs.

In certain embodiments, a RNAi molecule can be active in a RISC complex, with a length of duplex region active for RISC.

In additional embodiments, a RNAi molecule can be active as a Dicer substrate, to be converted to a RNAi molecule that can be active in a RISC complex.

In some aspects, a RNAi molecule can have complementary guide and passenger sequence portions at opposing ends of a long molecule, so that the molecule can form a duplex region with the complementary sequence portions, and the strands are linked at one end of the duplex region by either nucleotide or non-nucleotide linkers. For example, a hairpin arrangement, or a stem and loop arrangement. The linker interactions with the strands can be covalent bonds or non-covalent interactions.

A RNAi molecule of this disclosure may include a nucleotide, non-nucleotide, or mixed nucleotide/non-nucleotide linker that joins the sense region of the nucleic acid to the antisense region of the nucleic acid. A nucleotide linker can be a linker of 2 nucleotides in length, for example about 3, 4, 5, 6, 7, 8, 9, or 10 nucleotides in length. The nucleotide linker can be a nucleic acid aptamer. By "aptamer" or "nucleic acid aptamer" as used herein refers to a nucleic acid molecule that binds specifically to a target molecule wherein the nucleic acid molecule has sequence that includes a sequence recognized by the target molecule in its natural setting. Alternately, an aptamer can be a nucleic acid molecule that binds to a target molecule, where the target molecule does not naturally bind to a nucleic acid. For example, the aptamer can be used to bind to a ligand-binding domain of a protein, thereby preventing interaction of the naturally occurring ligand with the protein. See, e.g., Gold et al., Annu Rev Biochem, 1995, Vol. 64, pp. 763-797; Brody et al., J. Biotechnol., 2000, Vol. 74, pp. 5-13; Hermann et al., Science, 2000, Vol. 287, pp. 820-825.

Examples of a non-nucleotide linker include an abasic nucleotide, polyether, polyamine, polyamide, peptide, carbohydrate, lipid, polyhydrocarbon, or other polymeric compounds, for example polyethylene glycols such as those having from 2 to 100 ethylene glycol units. Some examples are described in Seela et al., Nucleic Acids Research, 1987, Vol. 15, pp. 3113-3129; Cload et al., J. Am. Chem. Soc., 1991, Vol. 113, pp. 6324-6326; Jaeschke et al., Tetrahedron Lett., 1993, Vol. 34, pp. 301; Arnold et al., WO1989/002439; Usman et al., WO1995/006731; Dudycz et al., WO1995/011910, and Ferentz et al., J. Am. Chem. Soc., 1991, Vol. 113, pp. 4000-4002.

A RNAi molecule can have one or more overhangs from the duplex region. The overhangs, which are non-base-paired, single strand regions, can be from one to eight nucleotides in length, or longer. An overhang can be a 3'-end overhang, wherein the 3'-end of a strand has a single strand region of from one to eight nucleotides. An overhang can be a 5'-end overhang, wherein the 5'-end of a strand has a single strand region of from one to eight nucleotides.

The overhangs of a RNAi molecule can have the same length, or can be different lengths.

A RNAi molecule can have one or more blunt ends, in which the duplex region ends with no overhang, and the strands are base paired to the end of the duplex region.

A RNAi molecule of this disclosure can have one or more blunt ends, or can have one or more overhangs, or can have a combination of a blunt end and an overhang end.

A 5'-end of a strand of a RNAi molecule may be in a blunt end, or can be in an overhang. A 3'-end of a strand of a RNAi molecule may be in a blunt end, or can be in an overhang.

A 5'-end of a strand of a RNAi molecule may be in a blunt end, while the 3'-end is in an overhang. A 3'-end of a strand of a RNAi molecule may be in a blunt end, while the 5'-end is in an overhang.

In some embodiments, both ends of a RNAi molecule are blunt ends.

In additional embodiments, both ends of a RNAi molecule have an overhang.

The overhangs at the 5'- and 3'-ends may be of different lengths.

In certain embodiments, a RNAi molecule may have a blunt end where the 5'-end of the antisense strand and the 3'-end of the sense strand do not have any overhanging nucleotides.

In further embodiments, a RNAi molecule may have a blunt end where the 3'-end of the antisense strand and the 5'-end of the sense strand do not have any overhanging nucleotides.

A RNAi molecule may have mismatches in base pairing in the duplex region.

Any nucleotide in an overhang of a RNAi molecule can be a deoxyribonucleotide, or a ribonucleotide.

One or more deoxyribonucleotides may be at the 5'-end, where the 3'-end of the other strand of the RNAi molecule may not have an overhang, or may not have a deoxyribonucleotide overhang.

One or more deoxyribonucleotides may be at the 3'-end, where the 5'-end of the other strand of the RNAi molecule may not have an overhang, or may not have a deoxyribonucleotide overhang.

In some embodiments, one or more, or all of the overhang nucleotides of a RNAi molecule may be 2'-deoxyribonucleotides.

Dicer Substrate RNAi Molecules

In some aspects, a RNAi molecule can be of a length suitable as a Dicer substrate, which can be processed to produce a RISC active RNAi molecule. See, e.g., Rossi et al., US2005/0244858.

A double stranded RNA (dsRNA) that is a Dicer substrate can be of a length sufficient such that it is processed by Dicer to produce an active RNAi molecule, and may further include one or more of the following properties: (i) the Dicer substrate dsRNA can be asymmetric, for example, having a 3' overhang on the antisense strand, and (ii) the Dicer substrate dsRNA can have a modified 3' end on the sense strand to direct orientation of Dicer binding and processing of the dsRNA to an active RNAi molecule.

In certain embodiments, the longest strand in a Dicer substrate dsRNA may be 24-30 nucleotides in length.

A Dicer substrate dsRNA can be symmetric or asymmetric.

In some embodiments, a Dicer substrate dsRNA can have a sense strand of 22-28 nucleotides and an antisense strand of 24-30 nucleotides.

In certain embodiments, a Dicer substrate dsRNA may have an overhang on the 3' end of the antisense strand.

In further embodiments, a Dicer substrate dsRNA may have a sense strand 25 nucleotides in length, and an antisense strand 27 nucleotides in length, with a 2 base 3'-overhang. The overhang may be 1, 2 or 3 nucleotides in length. The sense strand may also have a 5' phosphate.

An asymmetric Dicer substrate dsRNA may have two deoxyribonucleotides at the 3'-end of the sense strand in place of two of the ribonucleotides.

The sense strand of a Dicer substrate dsRNA may be from about 22 to about 30, or from about 22 to about 28; or from about 24 to about 30; or from about 25 to about 30; or from about 26 to about 30; or from about 26 and 29; or from about 27 to about 28 nucleotides in length.

The sense strand of a Dicer substrate dsRNA may be 22, 23, 24, 25, 26, 27, 28, 29 or 30 nucleotides in length.

In certain embodiments, a Dicer substrate dsRNA may have sense and antisense strands that are at least about 25 nucleotides in length, and no longer than about 30 nucleotides in length.

In certain embodiments, a Dicer substrate dsRNA may have sense and antisense strands that are 26 to 29 nucleotides in length.

In certain embodiments, a Dicer substrate dsRNA may have sense and antisense strands that are 27 nucleotides in length.

The sense and antisense strands of a Dicer substrate dsRNA may be the same length as in being blunt ended, or different lengths as in having overhangs, or may have a blunt end and an overhang.

A Dicer substrate dsRNA may have a duplex region of 19, 20, 21, 22, 23, 24, 25, 26 or 27 nucleotides in length.

The antisense strand of a Dicer substrate dsRNA may have any sequence that anneals to at least a portion of the sequence of the sense strand under biological conditions, such as within the cytoplasm of a eukaryotic cell.

A Dicer substrate with a sense and an antisense strand can be linked by a third structure, such as a linker group or a linker oligonucleotide. The linker connects the two strands of the dsRNA, for example, so that a hairpin is formed upon annealing.

The sense and antisense strands of a Dicer substrate are in general complementary, but may have mismatches in base pairing.

In some embodiments, a Dicer substrate dsRNA can be asymmetric such that the sense strand has 22-28 nucleotides and the antisense strand has 24-30 nucleotides.

A region of one of the strands, particularly the antisense strand, of the Dicer substrate dsRNA may have a sequence length of at least 19 nucleotides, wherein these nucleotides are in the 21-nucleotide region adjacent to the 3' end of the antisense strand and are sufficiently complementary to a nucleotide sequence of the RNA produced from the target gene.

An antisense strand of a Dicer substrate dsRNA can have from 1 to 9 ribonucleotides on the 5'-end, to give a length of 22-28 nucleotides. When the antisense strand has a length of 21 nucleotides, then 1-7 ribonucleotides, or 2-5 ribonucleotides, or 4 ribonucleotides may be added on the 3'-end. The added ribonucleotides may have any sequence.

A sense strand of a Dicer substrate dsRNA may have 24-30 nucleotides. The sense strand may be substantially complementary with the antisense strand to anneal to the antisense strand under biological conditions.

Methods of Use of RNAi Molecules

The nucleic acid molecules and RNAi molecules of this invention may be delivered to a cell or tissue by direct application of the molecules, or with the molecules combined with a carrier or a diluent.

The nucleic acid molecules and RNAi molecules of this invention can be delivered or administered to a cell, tissue, organ, or subject by direct application of the molecules with a carrier or diluent, or any other delivery vehicle that acts to assist, promote or facilitate entry into a cell, for example, viral sequences, viral material, or lipid or liposome formulations.

The nucleic acid molecules and RNAi molecules of this invention can be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection.

Delivery systems may include, for example, aqueous and nonaqueous gels, creams, emulsions, microemulsions, liposomes, ointments, aqueous and nonaqueous solutions, lotions, aerosols, hydrocarbon bases and powders, and can contain excipients such as solubilizers and permeation enhancers.

Compositions and methods of this disclosure can include an expression vector that includes a nucleic acid sequence encoding at least one RNAi molecule of this invention in a manner that allows expression of the nucleic acid molecule.

The nucleic acid molecules and RNAi molecules of this invention can be expressed from transcription units inserted into DNA or RNA vectors. Recombinant vectors can be DNA plasmids or viral vectors. Viral vectors can be used that provide for transient expression of nucleic acid molecules.

For example, the vector may contain sequences encoding both strands of a RNAi molecule of a duplex, or a single nucleic acid molecule that is self-complementary and thus forms a RNAi molecule. An expression vector may include a nucleic acid sequence encoding two or more nucleic acid molecules.

A nucleic acid molecule may be expressed within cells from eukaryotic promoters. Those skilled in the art realize that any nucleic acid can be expressed in eukaryotic cells from the appropriate DNA/RNA vector.

In some aspects, a viral construct can be used to introduce an expression construct into a cell, for transcription of a dsRNA construct encoded by the expression construct.

Lipid formulations can be administered to animals by intravenous, intramuscular, or intraperitoneal injection, or orally or by inhalation or other methods as are known in the art.

Pharmaceutically acceptable formulations for administering oligonucleotides are known and can be used.

EXAMPLES

Example 1: In Vitro Knockdown Using p21 siRNAs

FIG. 2 shows p21 siRNAs tested for ability to down regulate p21 mRNA in A549 cells. A549 cells were plated at 2000/well, 24 hours before transfection. Cells were then transfected with p21 siRNAs at 0.1, 1, and 10 nM concentrations for 24 hours. The fold change of p21 expression level was measured using qRT-PCR (n=3). All of the p21 siRNAs in FIG. 2 achieved significant knockdown of p21 mRNA in A549 cells.

Example 2: Protocol for In Vitro Knockdown

One day before the transfection, plate the cells in a 96-well plate at 2×103 cells per well with 100 µl of DMEM (HyClone Cat. #SH30243.01) containing 10% FBS and culture in a 37° C. incubator containing a humidified atmosphere of 5% CO2 in air. Before transfection, change medium to 90 µl of Opti-MEM I Reduced Serum Medium (Life Technologies Cat. #31985-070) containing 2% FBS. Mix 0.2 µl of Lipofectamine RNAiMax (Life Technologies Cat. #13778-100) with 4.8 µl of Opti-MEM I for 5 minutes at room temperature. Mix 1 µl of siRNA with 4 µl of Opti-MEM I and combine with the LF2000 solution and then mix gently, without vortex. Wait for 5 minutes at room temperature. Incubate the mixture for 10 minutes at room temperature to allow the RNA-RNAiMax complexes to form. Add the 10 µl of RNA-RNAiMax complexes to a well and shake the plate gently by hand. Incubate the cells in a 37° C. incubator containing a humidified atmosphere of 5% CO2 in air for 2 hours. Change medium to fresh-MEM I Reduced Serum Medium (Life Technologies Cat. #31985-

070) containing 2% FBS. 24 hours after transfection, wash the cells with ice-cold PBS once. Lyse the cells with 50 µl of Cell-to-Ct Lysis Buffer (Life Technologies Cat. #4391851 C) for 5-30 minutes at room temperature. Add 5 µl of Stop Solution and incubate for 2 minutes at room temperature. Measure mRNA level by RT-qPCR with TAQMAN immediately. Alternatively, the samples can be frozen at −80° C. and assayed at a later time.

The positive control for the screening measurement was a molecule having the sense and antisense strand pair of SEQ ID NO:4120 and 4121 (Ref. Pos. 830) (Ambion, Austin).

```
                              SEQ ID NO: 4120
Sense:       TCCTAAGAGTGCTGGGCATmUmU SEQ ID NO: 4121
Antisense:   AUGCCCAGCACUCUUAGGAmUmU.
```

Example 3 siRNAs of this invention targeted to p21 were found to be active for gene silencing in vitro. The dose-dependent activities of p21 siRNAs for gene knockdown were found to exhibit an IC50 below about 3 picomolar (pM), and as low as 1 pM.

In vitro transfection was performed in an A549 cell line to determine siRNA knockdown efficacy. Dose dependent knockdown for p21 mRNA was observed with siRNAs of Table 1, as shown in Table 3.

TABLE 3

Dose dependent knockdown for p21 mRNA in an A549 cell line

| P21 siRNA structure | IC50 (pM) |
| --- | --- |
| 1735 (SEQ ID NOs: 4075 and 4103) | 0.3 |
| 2042 (SEQ ID NOs: 4091 and 4119) | 10 |

As shown in Table 3, the activities of p21 siRNAs of Table 1 were in the range 0.3-10 pM, which is suitable for many uses, including as a drug agent to be used in vivo.

The embodiments described herein are not limiting and one skilled in the art can readily appreciate that specific combinations of the modifications described herein can be tested without undue experimentation toward identifying nucleic acid molecules with improved RNAi activity.

All publications, patents and literature specifically mentioned herein are incorporated by reference in their entirety for all purposes.

It is understood that this invention is not limited to the particular methodology, protocols, materials, and reagents described, as these may vary. It is also to be understood that the terminology used herein is for the purpose of describing particular embodiments only, and is not intended to limit the scope of the present invention. It will be readily apparent to one skilled in the art that varying substitutions and modifications can be made to the description disclosed herein without departing from the scope and spirit of the description, and that those embodiments are within the scope of this description and the appended claims.

It must be noted that as used herein and in the appended claims, the singular forms "a", "an", and "the" include plural reference unless the context clearly dictates otherwise. As well, the terms "a" (or "an"), "one or more" and "at least one" can be used interchangeably herein. It is also to be noted that the terms "comprises," "comprising", "containing," "including", and "having" can be used interchangeably, and shall be read expansively and without limitation.

Recitation of ranges of values herein are merely intended to serve as a shorthand method of referring individually to each separate value falling within the range, unless otherwise indicated herein, and each separate value is incorporated into the specification as if it were individually recited herein. For Markush groups, those skilled in the art will recognize that this description includes the individual members, as well as subgroups of the members of the Markush group.

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever.

All of the features disclosed in this specification may be combined in any combination. Each feature disclosed in this specification may be replaced by an alternative feature serving the same, equivalent, or similar purpose.

SEQUENCE LISTING (4121 sequences)

SEQ ID NO: 1 - DNA, 2175 bp, Homo sapiens
gttgtatatcagggccgcgctgagctgcgccagctgaggtgtgagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaaaaaaaaaaaaaaaaaa

SEQ ID NO: 2 - RNA, 21 nt, Artificial Sequence
  Description of Artificial Sequence: Synthetic oligonucleotide
  modified_base (20)..(21): 2'-methoxy-nucleotide
augucagaaccggcugggguu

SEQ ID NO: 3 - RNA, 21 nt, Artificial Sequence
  Description of Artificial Sequence: Synthetic oligonucleotide
  modified_base (20)..(21): 2'-methoxy-nucleotide
ugucagaaccggcuggggauu

SEQ ID NO: 4 - RNA, 21 nt, Artificial Sequence
  Description of Artificial Sequence: Synthetic oligonucleotide
  modified_base (20)..(21): 2'-methoxy-nucleotide
gucagaaccggcuggggauuu

SEQ ID NO: 5 - RNA, 21 nt, Artificial Sequence
  Description of Artificial Sequence: Synthetic oligonucleotide
  modified_base (20)..(21): 2'-methoxy-nucleotide
ucagaaccggcuggggauguu

SEQ ID NO: 6 - RNA, 21 nt, Artificial Sequence
  Description of Artificial Sequence: Synthetic oligonucleotide
  modified_base (20)..(21): 2'-methoxy-nucleotide
cagaaccggcuggggauguuu

SEQ ID NO: 7 - RNA, 21 nt, Artificial Sequence
  Description of Artificial Sequence: Synthetic oligonucleotide
  modified_base (20)..(21): 2'-methoxy-nucleotide
agaaccggcuggggaugucuu

SEQ ID NO: 8 - RNA, 21 nt, Artificial Sequence
  Description of Artificial Sequence: Synthetic oligonucleotide
  modified_base (20)..(21): 2'-methoxy-nucleotide
gaaccggcuggggauguccuu

SEQ ID NO: 9 - RNA, 21 nt, Artificial Sequence
  Description of Artificial Sequence: Synthetic oligonucleotide
  modified_base (20)..(21): 2'-methoxy-nucleotide
aaccggcuggggauguccguu

SEQ ID NO: 10 - RNA, 21 nt, Artificial Sequence
  Description of Artificial Sequence: Synthetic oligonucleotide
  modified_base (20)..(21): 2'-methoxy-nucleotide
accggcuggggauguccguuu

SEQ ID NO: 11 - RNA, 21 nt, Artificial Sequence
  Description of Artificial Sequence: Synthetic oligonucleotide
  modified_base (20)..(21): 2'-methoxy-nucleotide
ccggcuggggauguccgucuu

SEQ ID NO: 12 - RNA, 21 nt, Artificial Sequence
  Description of Artificial Sequence: Synthetic oligonucleotide
  modified_base (20)..(21): 2'-methoxy-nucleotide
cggcuggggauguccgucauu

SEQ ID NO: 13 - RNA, 21 nt, Artificial Sequence
  Description of Artificial Sequence: Synthetic oligonucleotide
  modified_base (20)..(21): 2'-methoxy-nucleotide
ggcuggggauguccgucaguu

SEQ ID NO: 14 - RNA, 21 nt, Artificial Sequence
  Description of Artificial Sequence: Synthetic oligonucleotide
  modified_base (20)..(21): 2'-methoxy-nucleotide
gcuggggauguccgucagauu

SEQ ID NO: 15 - RNA, 21 nt, Artificial Sequence
  Description of Artificial Sequence: Synthetic oligonucleotide
  modified_base (20)..(21): 2'-methoxy-nucleotide
cuggggauguccgucagaauu

SEQ ID NO: 16 - RNA, 21 nt, Artificial Sequence
  Description of Artificial Sequence: Synthetic oligonucleotide
  modified_base (20)..(21): 2'-methoxy-nucleotide
uggggauguccgucagaacuu

SEQ ID NO: 17 - RNA, 21 nt, Artificial Sequence
  Description of Artificial Sequence: Synthetic oligonucleotide
  modified_base (20)..(21): 2'-methoxy-nucleotide
ggggauguccgucagaaccuu

SEQ ID NO: 18 - RNA, 21 nt, Artificial Sequence
  Description of Artificial Sequence: Synthetic oligonucleotide
  modified_base (20)..(21): 2'-methoxy-nucleotide
gggauguccgucagaacccuu

SEQ ID NO: 19 - RNA, 21 nt, Artificial Sequence
  Description of Artificial Sequence: Synthetic oligonucleotide
  modified_base (20)..(21): 2'-methoxy-nucleotide
ggauguccgucagaacccauu

SEQ ID NO: 20 - RNA, 21 nt, Artificial Sequence
  Description of Artificial Sequence: Synthetic oligonucleotide
  modified_base (20)..(21): 2'-methoxy-nucleotide
gauguccgucagaacccauuu

SEQ ID NO: 21 - RNA, 21 nt, Artificial Sequence
  Description of Artificial Sequence: Synthetic oligonucleotide
  modified_base (20)..(21): 2'-methoxy-nucleotide
auguccgucagaacccauguu

SEQ ID NO: 22 - RNA, 21 nt, Artificial Sequence
  Description of Artificial Sequence: Synthetic oligonucleotide
  modified_base (20)..(21): 2'-methoxy-nucleotide
uguccgucagaacccaugcuu

SEQ ID NO: 23 - RNA, 21 nt, Artificial Sequence
  Description of Artificial Sequence: Synthetic oligonucleotide
  modified_base (20)..(21): 2'-methoxy-nucleotide
guccgucagaacccaugcguu

SEQ ID NO: 24 - RNA, 21 nt, Artificial Sequence
  Description of Artificial Sequence: Synthetic oligonucleotide
  modified_base (20)..(21): 2'-methoxy-nucleotide
uccgucagaacccaugcgguu

SEQ ID NO: 25 - RNA, 21 nt, Artificial Sequence
  Description of Artificial Sequence: Synthetic oligonucleotide
  modified_base (20)..(21): 2'-methoxy-nucleotide
ccgucagaacccaugcggcuu

SEQ ID NO: 26 - RNA, 21 nt, Artificial Sequence
  Description of Artificial Sequence: Synthetic oligonucleotide
  modified_base (20)..(21): 2'-methoxy-nucleotide
cgucagaacccaugcggcauu

SEQ ID NO: 27 - RNA, 21 nt, Artificial Sequence
  Description of Artificial Sequence: Synthetic oligonucleotide
  modified_base (20)..(21): 2'-methoxy-nucleotide
gucagaacccaugcggcaguu

SEQ ID NO: 28 - RNA, 21 nt, Artificial Sequence
  Description of Artificial Sequence: Synthetic oligonucleotide
  modified_base (20)..(21): 2'-methoxy-nucleotide
ucagaacccaugcggcagcuu

SEQ ID NO: 29 - RNA, 21 nt, Artificial Sequence
  Description of Artificial Sequence: Synthetic oligonucleotide
  modified_base (20)..(21): 2'-methoxy-nucleotide
cagaacccaugcggcagcauu

SEQ ID NO: 30 - RNA, 21 nt, Artificial Sequence
  Description of Artificial Sequence: Synthetic oligonucleotide
  modified_base (20)..(21): 2'-methoxy-nucleotide
agaacccaugcggcagcaauu

SEQ ID NO: 31 - RNA, 21 nt, Artificial Sequence
  Description of Artificial Sequence: Synthetic oligonucleotide
  modified_base (20)..(21): 2'-methoxy-nucleotide
gaacccaugcggcagcaaguu

SEQ ID NO: 32 - RNA, 21 nt, Artificial Sequence
  Description of Artificial Sequence: Synthetic oligonucleotide
  modified_base (20)..(21): 2'-methoxy-nucleotide
aacccaugcggcagcaagguu

SEQ ID NO: 33 - RNA, 21 nt, Artificial Sequence
  Description of Artificial Sequence: Synthetic oligonucleotide
  modified_base (20)..(21): 2'-methoxy-nucleotide
acccaugcggcagcaaggcuu

SEQ ID NO: 34 - RNA, 21 nt, Artificial Sequence
  Description of Artificial Sequence: Synthetic oligonucleotide
  modified_base (20)..(21): 2'-methoxy-nucleotide
cccaugcggcagcaaggccuu

SEQ ID NO: 35 - RNA, 21 nt, Artificial Sequence
  Description of Artificial Sequence: Synthetic oligonucleotide
  modified_base (20)..(21): 2'-methoxy-nucleotide
ccaugcggcagcaaggccuuu

SEQ ID NO: 36 - RNA, 21 nt, Artificial Sequence
  Description of Artificial Sequence: Synthetic oligonucleotide
  modified_base (20)..(21): 2'-methoxy-nucleotide
caugcggcagcaaggccuguu

SEQ ID NO: 37 - RNA, 21 nt, Artificial Sequence
  Description of Artificial Sequence: Synthetic oligonucleotide
  modified_base (20)..(21): 2'-methoxy-nucleotide
augcggcagcaaggccugcuu

SEQ ID NO: 38 - RNA, 21 nt, Artificial Sequence
  Description of Artificial Sequence: Synthetic oligonucleotide
  modified_base (20)..(21): 2'-methoxy-nucleotide
ugcggcagcaaggccugccuu

SEQ ID NO: 39 - RNA, 21 nt, Artificial Sequence
  Description of Artificial Sequence: Synthetic oligonucleotide
  modified_base (20)..(21): 2'-methoxy-nucleotide
gcggcagcaaggccugccguu

SEQ ID NO: 40 - RNA, 21 nt, Artificial Sequence
  Description of Artificial Sequence: Synthetic oligonucleotide
  modified_base (20)..(21): 2'-methoxy-nucleotide
cggcagcaaggccugccgcuu

SEQ ID NO: 41 - RNA, 21 nt, Artificial Sequence
  Description of Artificial Sequence: Synthetic oligonucleotide
  modified_base (20)..(21): 2'-methoxy-nucleotide
ggcagcaaggccugccgccuu

SEQ ID NO: 42 - RNA, 21 nt, Artificial Sequence
  Description of Artificial Sequence: Synthetic oligonucleotide
  modified_base (20)..(21): 2'-methoxy-nucleotide
gcagcaaggccugccgccguu

SEQ ID NO: 43 - RNA, 21 nt, Artificial Sequence
  Description of Artificial Sequence: Synthetic oligonucleotide
  modified_base (20)..(21): 2'-methoxy-nucleotide
cagcaaggccugccgccgcuu

SEQ ID NO: 44 - RNA, 21 nt, Artificial Sequence
  Description of Artificial Sequence: Synthetic oligonucleotide
  modified_base (20)..(21): 2'-methoxy-nucleotide
agcaaggccugccgccgccuu

SEQ ID NO: 45 - RNA, 21 nt, Artificial Sequence
  Description of Artificial Sequence: Synthetic oligonucleotide
  modified_base (20)..(21): 2'-methoxy-nucleotide
gcaaggccugccgccgccuuu

SEQ ID NO: 46 - RNA, 21 nt, Artificial Sequence
  Description of Artificial Sequence: Synthetic oligonucleotide
  modified_base (20)..(21): 2'-methoxy-nucleotide
caaggccugccgccgccucuu

SEQ ID NO: 47 - RNA, 21 nt, Artificial Sequence
  Description of Artificial Sequence: Synthetic oligonucleotide
  modified_base (20)..(21): 2'-methoxy-nucleotide
aaggccugccgccgccucuuu

SEQ ID NO: 48 - RNA, 21 nt, Artificial Sequence
  Description of Artificial Sequence: Synthetic oligonucleotide
  modified_base (20)..(21): 2'-methoxy-nucleotide
aggccugccgccgccucuuuu

SEQ ID NO: 49 - RNA, 21 nt, Artificial Sequence
  Description of Artificial Sequence: Synthetic oligonucleotide
  modified_base (20)..(21): 2'-methoxy-nucleotide
ggccugccgccgccucuucuu

SEQ ID NO: 50 - RNA, 21 nt, Artificial Sequence
  Description of Artificial Sequence: Synthetic oligonucleotide
  modified_base (20)..(21): 2'-methoxy-nucleotide
gccugccgccgccucuucguu

SEQ ID NO: 51 - RNA, 21 nt, Artificial Sequence
  Description of Artificial Sequence: Synthetic oligonucleotide
  modified_base (20)..(21): 2'-methoxy-nucleotide
ccugccgccgccucuucgguu

SEQ ID NO: 52 - RNA, 21 nt, Artificial Sequence
  Description of Artificial Sequence: Synthetic oligonucleotide
  modified_base (20)..(21): 2'-methoxy-nucleotide
cugccgccgccucuucggcuu

SEQ ID NO: 53 - RNA, 21 nt, Artificial Sequence
  Description of Artificial Sequence: Synthetic oligonucleotide
  modified_base (20)..(21): 2'-methoxy-nucleotide
ugccgccgccucuucggccuu

SEQ ID NO: 54 - RNA, 21 nt, Artificial Sequence
  Description of Artificial Sequence: Synthetic oligonucleotide
  modified_base (20)..(21): 2'-methoxy-nucleotide
gccgccgccucuucggcccuu

SEQ ID NO: 55 - RNA, 21 nt, Artificial Sequence
  Description of Artificial Sequence: Synthetic oligonucleotide
  modified_base (20)..(21): 2'-methoxy-nucleotide
ccgccgccucuucggcccauu

SEQ ID NO: 56 - RNA, 21 nt, Artificial Sequence
  Description of Artificial Sequence: Synthetic oligonucleotide
  modified_base (20)..(21): 2'-methoxy-nucleotide
cgccgccucuucggcccaguu

SEQ ID NO: 57 - RNA, 21 nt, Artificial Sequence
  Description of Artificial Sequence: Synthetic oligonucleotide
  modified_base (20)..(21): 2'-methoxy-nucleotide
gccgccucuucggcccaguuu

SEQ ID NO: 58 - RNA, 21 nt, Artificial Sequence
  Description of Artificial Sequence: Synthetic oligonucleotide
  modified_base (20)..(21): 2'-methoxy-nucleotide
ccgccucuucggcccaguguu

SEQ ID NO: 59 - RNA, 21 nt, Artificial Sequence
  Description of Artificial Sequence: Synthetic oligonucleotide
  modified_base (20)..(21): 2'-methoxy-nucleotide
cgccucuucggcccagugguu

SEQ ID NO: 60 - RNA, 21 nt, Artificial Sequence
  Description of Artificial Sequence: Synthetic oligonucleotide
  modified_base (20)..(21): 2'-methoxy-nucleotide
gccucuucggcccaguggauu

SEQ ID NO: 61 - RNA, 21 nt, Artificial Sequence
  Description of Artificial Sequence: Synthetic oligonucleotide
  modified_base (20)..(21): 2'-methoxy-nucleotide
ccucuucggcccaguggacuu

SEQ ID NO: 62 - RNA, 21 nt, Artificial Sequence
  Description of Artificial Sequence: Synthetic oligonucleotide
  modified_base (20)..(21): 2'-methoxy-nucleotide
cucuucggcccaguggacauu

SEQ ID NO: 63 - RNA, 21 nt, Artificial Sequence
  Description of Artificial Sequence: Synthetic oligonucleotide
  modified_base (20)..(21): 2'-methoxy-nucleotide
ucuucggcccaguggacaguu

SEQ ID NO: 64 - RNA, 21 nt, Artificial Sequence
  Description of Artificial Sequence: Synthetic oligonucleotide
  modified_base (20)..(21): 2'-methoxy-nucleotide
cuucggcccaguggacagcuu

SEQ ID NO: 65 - RNA, 21 nt, Artificial Sequence
  Description of Artificial Sequence: Synthetic oligonucleotide
  modified_base (20)..(21): 2'-methoxy-nucleotide
uucggcccaguggacagcguu

SEQ ID NO: 66 - RNA, 21 nt, Artificial Sequence
  Description of Artificial Sequence: Synthetic oligonucleotide
  modified_base (20)..(21): 2'-methoxy-nucleotide
ucggcccaguggacagcgauu

SEQ ID NO: 67 - RNA, 21 nt, Artificial Sequence
  Description of Artificial Sequence: Synthetic oligonucleotide
  modified_base (20)..(21): 2'-methoxy-nucleotide
cggcccaguggacagcgaguu

SEQ ID NO: 68 - RNA, 21 nt, Artificial Sequence
  Description of Artificial Sequence: Synthetic oligonucleotide
  modified_base (20)..(21): 2'-methoxy-nucleotide
ggcccaguggacagcgagcuu

SEQ ID NO: 69 - RNA, 21 nt, Artificial Sequence
  Description of Artificial Sequence: Synthetic oligonucleotide
  modified_base (20)..(21): 2'-methoxy-nucleotide
gcccaguggacagcgagcauu

SEQ ID NO: 70 - RNA, 21 nt, Artificial Sequence
  Description of Artificial Sequence: Synthetic oligonucleotide
  modified_base (20)..(21): 2'-methoxy-nucleotide
cccaguggacagcgagcaguu

SEQ ID NO: 71 - RNA, 21 nt, Artificial Sequence
  Description of Artificial Sequence: Synthetic oligonucleotide
  modified_base (20)..(21): 2'-methoxy-nucleotide
ccaguggacagcgagcagcuu

SEQ ID NO: 72 - RNA, 21 nt, Artificial Sequence
  Description of Artificial Sequence: Synthetic oligonucleotide
  modified_base (20)..(21): 2'-methoxy-nucleotide
caguggacagcgagcagcuuu

SEQ ID NO: 73 - RNA, 21 nt, Artificial Sequence
  Description of Artificial Sequence: Synthetic oligonucleotide
  modified_base (20)..(21): 2'-methoxy-nucleotide
aguggacagcgagcagcuguu

SEQ ID NO: 74 - RNA, 21 nt, Artificial Sequence
  Description of Artificial Sequence: Synthetic oligonucleotide
  modified_base (20)..(21): 2'-methoxy-nucleotide
guggacagcgagcagcugauu

SEQ ID NO: 75 - RNA, 21 nt, Artificial Sequence
  Description of Artificial Sequence: Synthetic oligonucleotide
  modified_base (20)..(21): 2'-methoxy-nucleotide
uggacagcgagcagcugaguu

SEQ ID NO: 76 - RNA, 21 nt, Artificial Sequence
  Description of Artificial Sequence: Synthetic oligonucleotide
  modified_base (20)..(21): 2'-methoxy-nucleotide
ggacagcgagcagcugagcuu

SEQ ID NO: 77 - RNA, 21 nt, Artificial Sequence
  Description of Artificial Sequence: Synthetic oligonucleotide
  modified_base (20)..(21): 2'-methoxy-nucleotide
gacagcgagcagcugagccuu

SEQ ID NO: 78 - RNA, 21 nt, Artificial Sequence
  Description of Artificial Sequence: Synthetic oligonucleotide
  modified_base (20)..(21): 2'-methoxy-nucleotide
acagcgagcagcugagccguu

SEQ ID NO: 79 - RNA, 21 nt, Artificial Sequence
  Description of Artificial Sequence: Synthetic oligonucleotide
  modified_base (20)..(21): 2'-methoxy-nucleotide
cagcgagcagcugagccgcuu

SEQ ID NO: 80 - RNA, 21 nt, Artificial Sequence
  Description of Artificial Sequence: Synthetic oligonucleotide
  modified_base (20)..(21): 2'-methoxy-nucleotide
agcgagcagcugagccgcguu

SEQ ID NO: 81 - RNA, 21 nt, Artificial Sequence
  Description of Artificial Sequence: Synthetic oligonucleotide
  modified_base (20)..(21): 2'-methoxy-nucleotide
gcgagcagcugagccgcgauu

SEQ ID NO: 82 - RNA, 21 nt, Artificial Sequence
  Description of Artificial Sequence: Synthetic oligonucleotide
  modified_base (20)..(21): 2'-methoxy-nucleotide
cgagcagcugagccgcgacuu

SEQ ID NO: 83 - RNA, 21 nt, Artificial Sequence
  Description of Artificial Sequence: Synthetic oligonucleotide
  modified_base (20)..(21): 2'-methoxy-nucleotide
gagcagcugagccgcgacuuu

SEQ ID NO: 84 - RNA, 21 nt, Artificial Sequence
  Description of Artificial Sequence: Synthetic oligonucleotide
  modified_base (20)..(21): 2'-methoxy-nucleotide
agcagcugagccgcgacuguu

SEQ ID NO: 85 - RNA, 21 nt, Artificial Sequence
  Description of Artificial Sequence: Synthetic oligonucleotide
  modified_base (20)..(21): 2'-methoxy-nucleotide
gcagcugagccgcgacuguuu

SEQ ID NO: 86 - RNA, 21 nt, Artificial Sequence
  Description of Artificial Sequence: Synthetic oligonucleotide
  modified_base (20)..(21): 2'-methoxy-nucleotide
cagcugagccgcgacuguguu

SEQ ID NO: 87 - RNA, 21 nt, Artificial Sequence
  Description of Artificial Sequence: Synthetic oligonucleotide
  modified_base (20)..(21): 2'-methoxy-nucleotide
agcugagccgcgacugugauu

SEQ ID NO: 88 - RNA, 21 nt, Artificial Sequence
  Description of Artificial Sequence: Synthetic oligonucleotide
  modified_base (20)..(21): 2'-methoxy-nucleotide
gcugagccgcgacugugauuu

SEQ ID NO: 89 - RNA, 21 nt, Artificial Sequence
  Description of Artificial Sequence: Synthetic oligonucleotide
  modified_base (20)..(21): 2'-methoxy-nucleotide
cugagccgcgacugugauguu

SEQ ID NO: 90 - RNA, 21 nt, Artificial Sequence
  Description of Artificial Sequence: Synthetic oligonucleotide
  modified_base (20)..(21): 2'-methoxy-nucleotide
ugagccgcgacugugaugcuu

SEQ ID NO: 91 - RNA, 21 nt, Artificial Sequence
  Description of Artificial Sequence: Synthetic oligonucleotide
  modified_base (20)..(21): 2'-methoxy-nucleotide
gagccgcgacugugaugcguu

SEQ ID NO: 92 - RNA, 21 nt, Artificial Sequence
  Description of Artificial Sequence: Synthetic oligonucleotide
  modified_base (20)..(21): 2'-methoxy-nucleotide
agccgcgacugugaugcgcuu

SEQ ID NO: 93 - RNA, 21 nt, Artificial Sequence
  Description of Artificial Sequence: Synthetic oligonucleotide
  modified_base (20)..(21): 2'-methoxy-nucleotide
gccgcgacugugaugcgcuuu

SEQ ID NO: 94 - RNA, 21 nt, Artificial Sequence
  Description of Artificial Sequence: Synthetic oligonucleotide
  modified_base (20)..(21): 2'-methoxy-nucleotide
ccgcgacugugaugcgcuauu

SEQ ID NO: 95 - RNA, 21 nt, Artificial Sequence
  Description of Artificial Sequence: Synthetic oligonucleotide
  modified_base (20)..(21): 2'-methoxy-nucleotide
cgcgacugugaugcgcuaauu

SEQ ID NO: 96 - RNA, 21 nt, Artificial Sequence
  Description of Artificial Sequence: Synthetic oligonucleotide
  modified_base (20)..(21): 2'-methoxy-nucleotide
gcgacugugaugcgcuaauuu

SEQ ID NO: 97 - RNA, 21 nt, Artificial Sequence
  Description of Artificial Sequence: Synthetic oligonucleotide
  modified_base (20)..(21): 2'-methoxy-nucleotide
cgacugugaugcgcuaauguu

SEQ ID NO: 98 - RNA, 21 nt, Artificial Sequence
  Description of Artificial Sequence: Synthetic oligonucleotide
  modified_base (20)..(21): 2'-methoxy-nucleotide
gacugugaugcgcuaaugguu

SEQ ID NO: 99 - RNA, 21 nt, Artificial Sequence
  Description of Artificial Sequence: Synthetic oligonucleotide
  modified_base (20)..(21): 2'-methoxy-nucleotide
acugugaugcgcuaauggcuu

SEQ ID NO: 100 - RNA, 21 nt, Artificial Sequence
  Description of Artificial Sequence: Synthetic oligonucleotide
  modified_base (20)..(21): 2'-methoxy-nucleotide
cugugaugcgcuaauggcguu

SEQ ID NO: 101 - RNA, 21 nt, Artificial Sequence
  Description of Artificial Sequence: Synthetic oligonucleotide
  modified_base (20)..(21): 2'-methoxy-nucleotide
ugugaugcgcuaauggcgguu

SEQ ID NO: 102 - RNA, 21 nt, Artificial Sequence
  Description of Artificial Sequence: Synthetic oligonucleotide
  modified_base (20)..(21): 2'-methoxy-nucleotide
gugaugcgcuaauggcggguu

SEQ ID NO: 103 - RNA, 21 nt, Artificial Sequence
  Description of Artificial Sequence: Synthetic oligonucleotide
  modified_base (20)..(21): 2'-methoxy-nucleotide
ugaugcgcuaauggcgggcuu

SEQ ID NO: 104 - RNA, 21 nt, Artificial Sequence
  Description of Artificial Sequence: Synthetic oligonucleotide
  modified_base (20)..(21): 2'-methoxy-nucleotide
gaugcgcuaauggcgggcuuu

SEQ ID NO: 105 - RNA, 21 nt, Artificial Sequence
  Description of Artificial Sequence: Synthetic oligonucleotide
  modified_base (20)..(21): 2'-methoxy-nucleotide
augcgcuaauggcgggcuguu

SEQ ID NO: 106 - RNA, 21 nt, Artificial Sequence
  Description of Artificial Sequence: Synthetic oligonucleotide
  modified_base (20)..(21): 2'-methoxy-nucleotide
ugcgcuaauggcgggcugcuu

SEQ ID NO: 107 - RNA, 21 nt, Artificial Sequence
  Description of Artificial Sequence: Synthetic oligonucleotide
  modified_base (20)..(21): 2'-methoxy-nucleotide
gcgcuaauggcgggcugcauu

SEQ ID NO: 108 - RNA, 21 nt, Artificial Sequence
  Description of Artificial Sequence: Synthetic oligonucleotide
  modified_base (20)..(21): 2'-methoxy-nucleotide
cgcuaauggcgggcugcauuu

SEQ ID NO: 109 - RNA, 21 nt, Artificial Sequence
  Description of Artificial Sequence: Synthetic oligonucleotide
  modified_base (20)..(21): 2'-methoxy-nucleotide
gcuaauggcgggcugcaucuu

SEQ ID NO: 110 - RNA, 21 nt, Artificial Sequence
  Description of Artificial Sequence: Synthetic oligonucleotide
  modified_base (20)..(21): 2'-methoxy-nucleotide
cuaauggcgggcugcauccuu

SEQ ID NO: 111 - RNA, 21 nt, Artificial Sequence
  Description of Artificial Sequence: Synthetic oligonucleotide
  modified_base (20)..(21): 2'-methoxy-nucleotide
uaauggcgggcugcauccauu

SEQ ID NO: 112 - RNA, 21 nt, Artificial Sequence
  Description of Artificial Sequence: Synthetic oligonucleotide
  modified_base (20)..(21): 2'-methoxy-nucleotide
aauggcgggcugcauccaguu

SEQ ID NO: 113 - RNA, 21 nt, Artificial Sequence
  Description of Artificial Sequence: Synthetic oligonucleotide
  modified_base (20)..(21): 2'-methoxy-nucleotide
auggcgggcugcauccagguu

SEQ ID NO: 114 - RNA, 21 nt, Artificial Sequence
  Description of Artificial Sequence: Synthetic oligonucleotide
  modified_base (20)..(21): 2'-methoxy-nucleotide
uggcgggcugcauccaggauu

SEQ ID NO: 115 - RNA, 21 nt, Artificial Sequence
  Description of Artificial Sequence: Synthetic oligonucleotide
  modified_base (20)..(21): 2'-methoxy-nucleotide
ggcgggcugcauccaggaguu

SEQ ID NO: 116 - RNA, 21 nt, Artificial Sequence
  Description of Artificial Sequence: Synthetic oligonucleotide
  modified_base (20)..(21): 2'-methoxy-nucleotide
gcgggcugcauccaggagguu

SEQ ID NO: 117 - RNA, 21 nt, Artificial Sequence
  Description of Artificial Sequence: Synthetic oligonucleotide
  modified_base (20)..(21): 2'-methoxy-nucleotide
cgggcugcauccaggaggcuu

SEQ ID NO: 118 - RNA, 21 nt, Artificial Sequence
  Description of Artificial Sequence: Synthetic oligonucleotide
  modified_base (20)..(21): 2'-methoxy-nucleotide
gggcugcauccaggaggccuu

SEQ ID NO: 119 - RNA, 21 nt, Artificial Sequence
  Description of Artificial Sequence: Synthetic oligonucleotide
  modified_base (20)..(21): 2'-methoxy-nucleotide
ggcugcauccaggaggcccuu

SEQ ID NO: 120 - RNA, 21 nt, Artificial Sequence
  Description of Artificial Sequence: Synthetic oligonucleotide
  modified_base (20)..(21): 2'-methoxy-nucleotide
gcugcauccaggaggcccguu

SEQ ID NO: 121 - RNA, 21 nt, Artificial Sequence
  Description of Artificial Sequence: Synthetic oligonucleotide
  modified_base (20)..(21): 2'-methoxy-nucleotide
cugcauccaggaggcccguuu

SEQ ID NO: 122 - RNA, 21 nt, Artificial Sequence
  Description of Artificial Sequence: Synthetic oligonucleotide
  modified_base (20)..(21): 2'-methoxy-nucleotide
ugcauccaggaggcccguguu

SEQ ID NO: 123 - RNA, 21 nt, Artificial Sequence
  Description of Artificial Sequence: Synthetic oligonucleotide
  modified_base (20)..(21): 2'-methoxy-nucleotide
gcauccaggaggcccgugauu

SEQ ID NO: 124 - RNA, 21 nt, Artificial Sequence
  Description of Artificial Sequence: Synthetic oligonucleotide
  modified_base (20)..(21): 2'-methoxy-nucleotide
cauccaggaggcccgugaguu

SEQ ID NO: 125 - RNA, 21 nt, Artificial Sequence
  Description of Artificial Sequence: Synthetic oligonucleotide
  modified_base (20)..(21): 2'-methoxy-nucleotide
auccaggaggcccgugagcuu

SEQ ID NO: 126 - RNA, 21 nt, Artificial Sequence
  Description of Artificial Sequence: Synthetic oligonucleotide
  modified_base (20)..(21): 2'-methoxy-nucleotide
uccaggaggcccgugagcguu

SEQ ID NO: 127 - RNA, 21 nt, Artificial Sequence
  Description of Artificial Sequence: Synthetic oligonucleotide
  modified_base (20)..(21): 2'-methoxy-nucleotide
ccaggaggcccgugagcgauu

SEQ ID NO: 128 - RNA, 21 nt, Artificial Sequence
  Description of Artificial Sequence: Synthetic oligonucleotide
  modified_base (20)..(21): 2'-methoxy-nucleotide
caggaggcccgugagcgauuu

SEQ ID NO: 129 - RNA, 21 nt, Artificial Sequence
  Description of Artificial Sequence: Synthetic oligonucleotide
  modified_base (20)..(21): 2'-methoxy-nucleotide
aggaggcccgugagcgauguu

SEQ ID NO: 130 - RNA, 21 nt, Artificial Sequence
  Description of Artificial Sequence: Synthetic oligonucleotide
  modified_base (20)..(21): 2'-methoxy-nucleotide
ggaggcccgugagcgaugguu

SEQ ID NO: 131 - RNA, 21 nt, Artificial Sequence
  Description of Artificial Sequence: Synthetic oligonucleotide
  modified_base (20)..(21): 2'-methoxy-nucleotide
gaggcccgugagcgauggauu

SEQ ID NO: 132 - RNA, 21 nt, Artificial Sequence
  Description of Artificial Sequence: Synthetic oligonucleotide
  modified_base (20)..(21): 2'-methoxy-nucleotide
aggcccgugagcgauggaauu

SEQ ID NO: 133 - RNA, 21 nt, Artificial Sequence
  Description of Artificial Sequence: Synthetic oligonucleotide
  modified_base (20)..(21): 2'-methoxy-nucleotide
ggcccgugagcgauggaacuu

SEQ ID NO: 134 - RNA, 21 nt, Artificial Sequence
  Description of Artificial Sequence: Synthetic oligonucleotide
  modified_base (20)..(21): 2'-methoxy-nucleotide
gcccgugagcgauggaacuuu

SEQ ID NO: 135 - RNA, 21 nt, Artificial Sequence
  Description of Artificial Sequence: Synthetic oligonucleotide
  modified_base (20)..(21): 2'-methoxy-nucleotide
cccgugagcgauggaacuuuu

SEQ ID NO: 136 - RNA, 21 nt, Artificial Sequence
  Description of Artificial Sequence: Synthetic oligonucleotide
  modified_base (20)..(21): 2'-methoxy-nucleotide
ccgugagcgauggaacuucuu

SEQ ID NO: 137 - RNA, 21 nt, Artificial Sequence
  Description of Artificial Sequence: Synthetic oligonucleotide
  modified_base (20)..(21): 2'-methoxy-nucleotide
cgugagcgauggaacuucguu

SEQ ID NO: 138 - RNA, 21 nt, Artificial Sequence
  Description of Artificial Sequence: Synthetic oligonucleotide
  modified_base (20)..(21): 2'-methoxy-nucleotide
gugagcgauggaacuucgauu

SEQ ID NO: 139 - RNA, 21 nt, Artificial Sequence
  Description of Artificial Sequence: Synthetic oligonucleotide
  modified_base (20)..(21): 2'-methoxy-nucleotide
ugagcgauggaacuucgacuu

SEQ ID NO: 140 - RNA, 21 nt, Artificial Sequence
  Description of Artificial Sequence: Synthetic oligonucleotide
  modified_base (20)..(21): 2'-methoxy-nucleotide
gagcgauggaacuucgacuuu

SEQ ID NO: 141 - RNA, 21 nt, Artificial Sequence
  Description of Artificial Sequence: Synthetic oligonucleotide
  modified_base (20)..(21): 2'-methoxy-nucleotide
agcgauggaacuucgacuuuu

SEQ ID NO: 142 - RNA, 21 nt, Artificial Sequence
  Description of Artificial Sequence: Synthetic oligonucleotide
  modified_base (20)..(21): 2'-methoxy-nucleotide
gcgauggaacuucgacuuuuu

SEQ ID NO: 143 - RNA, 21 nt, Artificial Sequence
  Description of Artificial Sequence: Synthetic oligonucleotide
  modified_base (20)..(21): 2'-methoxy-nucleotide
cgauggaacuucgacuuuguu

SEQ ID NO: 144 - RNA, 21 nt, Artificial Sequence
  Description of Artificial Sequence: Synthetic oligonucleotide
  modified_base (20)..(21): 2'-methoxy-nucleotide
gauggaacuucgacuuuguuu

SEQ ID NO: 145 - RNA, 21 nt, Artificial Sequence
  Description of Artificial Sequence: Synthetic oligonucleotide
  modified_base (20)..(21): 2'-methoxy-nucleotide
auggaacuucgacuuugucuu

SEQ ID NO: 146 - RNA, 21 nt, Artificial Sequence
  Description of Artificial Sequence: Synthetic oligonucleotide
  modified_base (20)..(21): 2'-methoxy-nucleotide
uggaacuucgacuuugucauu

SEQ ID NO: 147 - RNA, 21 nt, Artificial Sequence
  Description of Artificial Sequence: Synthetic oligonucleotide
  modified_base (20)..(21): 2'-methoxy-nucleotide
ggaacuucgacuuugucacuu

SEQ ID NO: 148 - RNA, 21 nt, Artificial Sequence
  Description of Artificial Sequence: Synthetic oligonucleotide
  modified_base (20)..(21): 2'-methoxy-nucleotide
gaacuucgacuuugucaccuu

SEQ ID NO: 149 - RNA, 21 nt, Artificial Sequence
  Description of Artificial Sequence: Synthetic oligonucleotide
  modified_base (20)..(21): 2'-methoxy-nucleotide
aacuucgacuuugucaccguu

SEQ ID NO: 150 - RNA, 21 nt, Artificial Sequence
  Description of Artificial Sequence: Synthetic oligonucleotide
  modified_base (20)..(21): 2'-methoxy-nucleotide
acuucgacuuugucaccgauu

SEQ ID NO: 151 - RNA, 21 nt, Artificial Sequence
  Description of Artificial Sequence: Synthetic oligonucleotide
  modified_base (20)..(21): 2'-methoxy-nucleotide
cuucgacuuugucaccgaguu

SEQ ID NO: 152 - RNA, 21 nt, Artificial Sequence
  Description of Artificial Sequence: Synthetic oligonucleotide
  modified_base (20)..(21): 2'-methoxy-nucleotide
uucgacuuugucaccgagauu

SEQ ID NO: 153 - RNA, 21 nt, Artificial Sequence
  Description of Artificial Sequence: Synthetic oligonucleotide
  modified_base (20)..(21): 2'-methoxy-nucleotide
ucgacuuugucaccgagacuu

SEQ ID NO: 154 - RNA, 21 nt, Artificial Sequence
  Description of Artificial Sequence: Synthetic oligonucleotide
  modified_base (20)..(21): 2'-methoxy-nucleotide
cgacuuugucaccgagacauu

SEQ ID NO: 155 - RNA, 21 nt, Artificial Sequence
  Description of Artificial Sequence: Synthetic oligonucleotide
  modified_base (20)..(21): 2'-methoxy-nucleotide
gacuuugucaccgagacacuu

SEQ ID NO: 156 - RNA, 21 nt, Artificial Sequence
  Description of Artificial Sequence: Synthetic oligonucleotide
  modified_base (20)..(21): 2'-methoxy-nucleotide
acuuugucaccgagacaccuu

SEQ ID NO: 157 - RNA, 21 nt, Artificial Sequence
  Description of Artificial Sequence: Synthetic oligonucleotide
  modified_base (20)..(21): 2'-methoxy-nucleotide
cuuugucaccgagacaccauu

SEQ ID NO: 158 - RNA, 21 nt, Artificial Sequence
  Description of Artificial Sequence: Synthetic oligonucleotide
  modified_base (20)..(21): 2'-methoxy-nucleotide
uuugucaccgagacaccacuu

SEQ ID NO: 159 - RNA, 21 nt, Artificial Sequence
  Description of Artificial Sequence: Synthetic oligonucleotide
  modified_base (20)..(21): 2'-methoxy-nucleotide
uugucaccgagacaccacuuu

SEQ ID NO: 160 - RNA, 21 nt, Artificial Sequence
  Description of Artificial Sequence: Synthetic oligonucleotide
  modified_base (20)..(21): 2'-methoxy-nucleotide
ugucaccgagacaccacuguu

SEQ ID NO: 161 - RNA, 21 nt, Artificial Sequence
  Description of Artificial Sequence: Synthetic oligonucleotide
  modified_base (20)..(21): 2'-methoxy-nucleotide
gucaccgagacaccacugguu

SEQ ID NO: 162 - RNA, 21 nt, Artificial Sequence
  Description of Artificial Sequence: Synthetic oligonucleotide
  modified_base (20)..(21): 2'-methoxy-nucleotide
ucaccgagacaccacuggauu

SEQ ID NO: 163 - RNA, 21 nt, Artificial Sequence
  Description of Artificial Sequence: Synthetic oligonucleotide
  modified_base (20)..(21): 2'-methoxy-nucleotide
caccgagacaccacuggaguu

SEQ ID NO: 164 - RNA, 21 nt, Artificial Sequence
  Description of Artificial Sequence: Synthetic oligonucleotide
  modified_base (20)..(21): 2'-methoxy-nucleotide
accgagacaccacuggagguu

SEQ ID NO: 165 - RNA, 21 nt, Artificial Sequence
  Description of Artificial Sequence: Synthetic oligonucleotide
  modified_base (20)..(21): 2'-methoxy-nucleotide
ccgagacaccacuggaggguu

SEQ ID NO: 166 - RNA, 21 nt, Artificial Sequence
  Description of Artificial Sequence: Synthetic oligonucleotide
  modified_base (20)..(21): 2'-methoxy-nucleotide
cgagacaccacuggaggguuu

SEQ ID NO: 167 - RNA, 21 nt, Artificial Sequence
  Description of Artificial Sequence: Synthetic oligonucleotide
  modified_base (20)..(21): 2'-methoxy-nucleotide
gagacaccacuggaggguguu

SEQ ID NO: 168 - RNA, 21 nt, Artificial Sequence
  Description of Artificial Sequence: Synthetic oligonucleotide
  modified_base (20)..(21): 2'-methoxy-nucleotide
agacaccacuggagggugauu

SEQ ID NO: 169 - RNA, 21 nt, Artificial Sequence
  Description of Artificial Sequence: Synthetic oligonucleotide
  modified_base (20)..(21): 2'-methoxy-nucleotide
gacaccacuggagggugacuu

SEQ ID NO: 170 - RNA, 21 nt, Artificial Sequence
  Description of Artificial Sequence: Synthetic oligonucleotide
  modified_base (20)..(21): 2'-methoxy-nucleotide
acaccacuggagggugacuuu

SEQ ID NO: 171 - RNA, 21 nt, Artificial Sequence
  Description of Artificial Sequence: Synthetic oligonucleotide
  modified_base (20)..(21): 2'-methoxy-nucleotide
caccacuggagggugacuuuu

SEQ ID NO: 172 - RNA, 21 nt, Artificial Sequence
  Description of Artificial Sequence: Synthetic oligonucleotide
  modified_base (20)..(21): 2'-methoxy-nucleotide
accacuggagggugacuucuu

SEQ ID NO: 173 - RNA, 21 nt, Artificial Sequence
  Description of Artificial Sequence: Synthetic oligonucleotide
  modified_base (20)..(21): 2'-methoxy-nucleotide
ccacuggagggugacuucguu

SEQ ID NO: 174 - RNA, 21 nt, Artificial Sequence
  Description of Artificial Sequence: Synthetic oligonucleotide
  modified_base (20)..(21): 2'-methoxy-nucleotide
cacuggagggugacuucgcuu

SEQ ID NO: 175 - RNA, 21 nt, Artificial Sequence
  Description of Artificial Sequence: Synthetic oligonucleotide
  modified_base (20)..(21): 2'-methoxy-nucleotide
acuggagggugacuucgccuu

SEQ ID NO: 176 - RNA, 21 nt, Artificial Sequence
  Description of Artificial Sequence: Synthetic oligonucleotide
  modified_base (20)..(21): 2'-methoxy-nucleotide
cuggagggugacuucgccuuu

SEQ ID NO: 177 - RNA, 21 nt, Artificial Sequence
  Description of Artificial Sequence: Synthetic oligonucleotide
  modified_base (20)..(21): 2'-methoxy-nucleotide
uggagggugacuucgccuguu

SEQ ID NO: 178 - RNA, 21 nt, Artificial Sequence
  Description of Artificial Sequence: Synthetic oligonucleotide
  modified_base (20)..(21): 2'-methoxy-nucleotide
ggagggugacuucgccugguu

SEQ ID NO: 179 - RNA, 21 nt, Artificial Sequence
  Description of Artificial Sequence: Synthetic oligonucleotide
  modified_base (20)..(21): 2'-methoxy-nucleotide
gagggugacuucgccuggguu

SEQ ID NO: 180 - RNA, 21 nt, Artificial Sequence
  Description of Artificial Sequence: Synthetic oligonucleotide
  modified_base (20)..(21): 2'-methoxy-nucleotide
agggugacuucgccugggauu

SEQ ID NO: 181 - RNA, 21 nt, Artificial Sequence
  Description of Artificial Sequence: Synthetic oligonucleotide
  modified_base (20)..(21): 2'-methoxy-nucleotide
gggugacuucgccugggaguu

SEQ ID NO: 182 - RNA, 21 nt, Artificial Sequence
  Description of Artificial Sequence: Synthetic oligonucleotide
  modified_base (20)..(21): 2'-methoxy-nucleotide
ggugacuucgccugggagcuu

SEQ ID NO: 183 - RNA, 21 nt, Artificial Sequence
  Description of Artificial Sequence: Synthetic oligonucleotide
  modified_base (20)..(21): 2'-methoxy-nucleotide
gugacuucgccugggagcguu

SEQ ID NO: 184 - RNA, 21 nt, Artificial Sequence
  Description of Artificial Sequence: Synthetic oligonucleotide
  modified_base (20)..(21): 2'-methoxy-nucleotide
ugacuucgccugggagcguuu

SEQ ID NO: 185 - RNA, 21 nt, Artificial Sequence
  Description of Artificial Sequence: Synthetic oligonucleotide
  modified_base (20)..(21): 2'-methoxy-nucleotide
gacuucgccugggagcguguu

SEQ ID NO: 186 - RNA, 21 nt, Artificial Sequence
  Description of Artificial Sequence: Synthetic oligonucleotide
  modified_base (20)..(21): 2'-methoxy-nucleotide
acuucgccugggagcguguuu

SEQ ID NO: 187 - RNA, 21 nt, Artificial Sequence
  Description of Artificial Sequence: Synthetic oligonucleotide
  modified_base (20)..(21): 2'-methoxy-nucleotide
cuucgccugggagcguguguu

SEQ ID NO: 188 - RNA, 21 nt, Artificial Sequence
  Description of Artificial Sequence: Synthetic oligonucleotide
  modified_base (20)..(21): 2'-methoxy-nucleotide
uucgccugggagcgugugcuu

SEQ ID NO: 189 - RNA, 21 nt, Artificial Sequence
  Description of Artificial Sequence: Synthetic oligonucleotide
  modified_base (20)..(21): 2'-methoxy-nucleotide
ucgccugggagcgugugcguu

SEQ ID NO: 190 - RNA, 21 nt, Artificial Sequence
  Description of Artificial Sequence: Synthetic oligonucleotide
  modified_base (20)..(21): 2'-methoxy-nucleotide
cgccugggagcgugugcgguu

SEQ ID NO: 191 - RNA, 21 nt, Artificial Sequence
  Description of Artificial Sequence: Synthetic oligonucleotide
  modified_base (20)..(21): 2'-methoxy-nucleotide
gccugggagcgugugcggguu

SEQ ID NO: 192 - RNA, 21 nt, Artificial Sequence
  Description of Artificial Sequence: Synthetic oligonucleotide
  modified_base (20)..(21): 2'-methoxy-nucleotide
ccugggagcgugugcgggguu

SEQ ID NO: 193 - RNA, 21 nt, Artificial Sequence
  Description of Artificial Sequence: Synthetic oligonucleotide
  modified_base (20)..(21): 2'-methoxy-nucleotide
cugggagcgugugcggggcuu

SEQ ID NO: 194 - RNA, 21 nt, Artificial Sequence
  Description of Artificial Sequence: Synthetic oligonucleotide
  modified_base (20)..(21): 2'-methoxy-nucleotide
ugggagcgugugcggggccuu

SEQ ID NO: 195 - RNA, 21 nt, Artificial Sequence
  Description of Artificial Sequence: Synthetic oligonucleotide
  modified_base (20)..(21): 2'-methoxy-nucleotide
gggagcgugugcggggccuuu

SEQ ID NO: 196 - RNA, 21 nt, Artificial Sequence
  Description of Artificial Sequence: Synthetic oligonucleotide
  modified_base (20)..(21): 2'-methoxy-nucleotide
ggagcgugugcggggccuuuu

SEQ ID NO: 197 - RNA, 21 nt, Artificial Sequence
  Description of Artificial Sequence: Synthetic oligonucleotide
  modified_base (20)..(21): 2'-methoxy-nucleotide
gagcgugugcggggccuuguu

SEQ ID NO: 198 - RNA, 21 nt, Artificial Sequence
  Description of Artificial Sequence: Synthetic oligonucleotide
  modified_base (20)..(21): 2'-methoxy-nucleotide
agcgugugcggggccuugguu

SEQ ID NO: 199 - RNA, 21 nt, Artificial Sequence
  Description of Artificial Sequence: Synthetic oligonucleotide
  modified_base (20)..(21): 2'-methoxy-nucleotide
gcgugugcggggccuuggcuu

SEQ ID NO: 200 - RNA, 21 nt, Artificial Sequence
  Description of Artificial Sequence: Synthetic oligonucleotide
  modified_base (20)..(21): 2'-methoxy-nucleotide
cgugugcggggccuuggccuu

SEQ ID NO: 201 - RNA, 21 nt, Artificial Sequence
  Description of Artificial Sequence: Synthetic oligonucleotide
  modified_base (20)..(21): 2'-methoxy-nucleotide
gugugcggggccuuggccuuu

SEQ ID NO: 202 - RNA, 21 nt, Artificial Sequence
  Description of Artificial Sequence: Synthetic oligonucleotide
  modified_base (20)..(21): 2'-methoxy-nucleotide
ugugcggggccuuggccuguu

SEQ ID NO: 203 - RNA, 21 nt, Artificial Sequence
  Description of Artificial Sequence: Synthetic oligonucleotide
  modified_base (20)..(21): 2'-methoxy-nucleotide
gugcggggccuuggccugcuu

SEQ ID NO: 204 - RNA, 21 nt, Artificial Sequence
  Description of Artificial Sequence: Synthetic oligonucleotide
  modified_base (20)..(21): 2'-methoxy-nucleotide
ugcggggccuuggccugccuu

SEQ ID NO: 205 - RNA, 21 nt, Artificial Sequence
  Description of Artificial Sequence: Synthetic oligonucleotide
  modified_base (20)..(21): 2'-methoxy-nucleotide
gcggggccuuggccugcccuu

SEQ ID NO: 206 - RNA, 21 nt, Artificial Sequence
  Description of Artificial Sequence: Synthetic oligonucleotide
  modified_base (20)..(21): 2'-methoxy-nucleotide
cggggccuuggccugcccauu

SEQ ID NO: 207 - RNA, 21 nt, Artificial Sequence
  Description of Artificial Sequence: Synthetic oligonucleotide
  modified_base (20)..(21): 2'-methoxy-nucleotide
ggggccuuggccugcccaauu

SEQ ID NO: 208 - RNA, 21 nt, Artificial Sequence
  Description of Artificial Sequence: Synthetic oligonucleotide
  modified_base (20)..(21): 2'-methoxy-nucleotide
gggccuuggccugcccaaguu

SEQ ID NO: 209 - RNA, 21 nt, Artificial Sequence
  Description of Artificial Sequence: Synthetic oligonucleotide
  modified_base (20)..(21): 2'-methoxy-nucleotide
ggccuuggccugcccaagcuu

SEQ ID NO: 210 - RNA, 21 nt, Artificial Sequence
  Description of Artificial Sequence: Synthetic oligonucleotide
  modified_base (20)..(21): 2'-methoxy-nucleotide
gccuuggccugcccaagcuuu

SEQ ID NO: 211 - RNA, 21 nt, Artificial Sequence
  Description of Artificial Sequence: Synthetic oligonucleotide
  modified_base (20)..(21): 2'-methoxy-nucleotide
ccuuggccugcccaagcucuu

SEQ ID NO: 212 - RNA, 21 nt, Artificial Sequence
  Description of Artificial Sequence: Synthetic oligonucleotide
  modified_base (20)..(21): 2'-methoxy-nucleotide
cuuggccugcccaagcucuuu

SEQ ID NO: 213 - RNA, 21 nt, Artificial Sequence
  Description of Artificial Sequence: Synthetic oligonucleotide
  modified_base (20)..(21): 2'-methoxy-nucleotide
uuggccugcccaagcucuauu

SEQ ID NO: 214 - RNA, 21 nt, Artificial Sequence
  Description of Artificial Sequence: Synthetic oligonucleotide
  modified_base (20)..(21): 2'-methoxy-nucleotide
uggccugcccaagcucuacuu

SEQ ID NO: 215 - RNA, 21 nt, Artificial Sequence
  Description of Artificial Sequence: Synthetic oligonucleotide
  modified_base (20)..(21): 2'-methoxy-nucleotide
ggccugcccaagcucuaccuu

SEQ ID NO: 216 - RNA, 21 nt, Artificial Sequence
  Description of Artificial Sequence: Synthetic oligonucleotide
  modified_base (20)..(21): 2'-methoxy-nucleotide
gccugcccaagcucuaccuuu

SEQ ID NO: 217 - RNA, 21 nt, Artificial Sequence
  Description of Artificial Sequence: Synthetic oligonucleotide
  modified_base (20)..(21): 2'-methoxy-nucleotide
ccugcccaagcucuaccuuuu

SEQ ID NO: 218 - RNA, 21 nt, Artificial Sequence
  Description of Artificial Sequence: Synthetic oligonucleotide
  modified_base (20)..(21): 2'-methoxy-nucleotide
cugcccaagcucuaccuucuu

SEQ ID NO: 219 - RNA, 21 nt, Artificial Sequence
  Description of Artificial Sequence: Synthetic oligonucleotide
  modified_base (20)..(21): 2'-methoxy-nucleotide
ugcccaagcucuaccuuccuu

SEQ ID NO: 220 - RNA, 21 nt, Artificial Sequence
  Description of Artificial Sequence: Synthetic oligonucleotide
  modified_base (20)..(21): 2'-methoxy-nucleotide
gcccaagcucuaccuucccuu

SEQ ID NO: 221 - RNA, 21 nt, Artificial Sequence
  Description of Artificial Sequence: Synthetic oligonucleotide
  modified_base (20)..(21): 2'-methoxy-nucleotide
cccaagcucuaccuucccauu

SEQ ID NO: 222 - RNA, 21 nt, Artificial Sequence
  Description of Artificial Sequence: Synthetic oligonucleotide
  modified_base (20)..(21): 2'-methoxy-nucleotide
ccaagcucuaccuucccacuu

SEQ ID NO: 223 - RNA, 21 nt, Artificial Sequence
  Description of Artificial Sequence: Synthetic oligonucleotide
  modified_base (20)..(21): 2'-methoxy-nucleotide
caagcucuaccuucccacguu

SEQ ID NO: 224 - RNA, 21 nt, Artificial Sequence
  Description of Artificial Sequence: Synthetic oligonucleotide
  modified_base (20)..(21): 2'-methoxy-nucleotide
aagcucuaccuucccacgguu

SEQ ID NO: 225 - RNA, 21 nt, Artificial Sequence
  Description of Artificial Sequence: Synthetic oligonucleotide
  modified_base (20)..(21): 2'-methoxy-nucleotide
agcucuaccuucccacggguu

SEQ ID NO: 226 - RNA, 21 nt, Artificial Sequence
  Description of Artificial Sequence: Synthetic oligonucleotide
  modified_base (20)..(21): 2'-methoxy-nucleotide
gcucuaccuucccacgggguu

SEQ ID NO: 227 - RNA, 21 nt, Artificial Sequence
  Description of Artificial Sequence: Synthetic oligonucleotide
  modified_base (20)..(21): 2'-methoxy-nucleotide
cucuaccuucccacggggcuu

SEQ ID NO: 228 - RNA, 21 nt, Artificial Sequence
  Description of Artificial Sequence: Synthetic oligonucleotide
  modified_base (20)..(21): 2'-methoxy-nucleotide
ucuaccuucccacggggccuu

SEQ ID NO: 229 - RNA, 21 nt, Artificial Sequence
  Description of Artificial Sequence: Synthetic oligonucleotide
  modified_base (20)..(21): 2'-methoxy-nucleotide
cuaccuucccacggggcccuu

SEQ ID NO: 230 - RNA, 21 nt, Artificial Sequence
  Description of Artificial Sequence: Synthetic oligonucleotide
  modified_base (20)..(21): 2'-methoxy-nucleotide
uaccuucccacggggccccuu

SEQ ID NO: 231 - RNA, 21 nt, Artificial Sequence
  Description of Artificial Sequence: Synthetic oligonucleotide
  modified_base (20)..(21): 2'-methoxy-nucleotide
accuucccacggggccccguu

SEQ ID NO: 232 - RNA, 21 nt, Artificial Sequence
  Description of Artificial Sequence: Synthetic oligonucleotide
  modified_base (20)..(21): 2'-methoxy-nucleotide
ccuucccacggggccccgguu

SEQ ID NO: 233 - RNA, 21 nt, Artificial Sequence
  Description of Artificial Sequence: Synthetic oligonucleotide
  modified_base (20)..(21): 2'-methoxy-nucleotide
cuucccacggggccccggcuu

SEQ ID NO: 234 - RNA, 21 nt, Artificial Sequence
  Description of Artificial Sequence: Synthetic oligonucleotide
  modified_base (20)..(21): 2'-methoxy-nucleotide
uucccacggggccccggcguu

SEQ ID NO: 235 - RNA, 21 nt, Artificial Sequence
  Description of Artificial Sequence: Synthetic oligonucleotide
  modified_base (20)..(21): 2'-methoxy-nucleotide
ucccacggggccccggcgauu

SEQ ID NO: 236 - RNA, 21 nt, Artificial Sequence
  Description of Artificial Sequence: Synthetic oligonucleotide
  modified_base (20)..(21): 2'-methoxy-nucleotide
cccacggggccccggcgaguu

SEQ ID NO: 237 - RNA, 21 nt, Artificial Sequence
  Description of Artificial Sequence: Synthetic oligonucleotide
  modified_base (20)..(21): 2'-methoxy-nucleotide
ccacggggccccggcgagguu

SEQ ID NO: 238 - RNA, 21 nt, Artificial Sequence
  Description of Artificial Sequence: Synthetic oligonucleotide
  modified_base (20)..(21): 2'-methoxy-nucleotide
cacggggccccggcgaggcuu

SEQ ID NO: 239 - RNA, 21 nt, Artificial Sequence
  Description of Artificial Sequence: Synthetic oligonucleotide
  modified_base (20)..(21): 2'-methoxy-nucleotide
acggggccccggcgaggccuu

SEQ ID NO: 240 - RNA, 21 nt, Artificial Sequence
  Description of Artificial Sequence: Synthetic oligonucleotide
  modified_base (20)..(21): 2'-methoxy-nucleotide
cggggccccggcgaggccguu

SEQ ID NO: 241 - RNA, 21 nt, Artificial Sequence
  Description of Artificial Sequence: Synthetic oligonucleotide
  modified_base (20)..(21): 2'-methoxy-nucleotide
ggggccccggcgaggccgguu

SEQ ID NO: 242 - RNA, 21 nt, Artificial Sequence
  Description of Artificial Sequence: Synthetic oligonucleotide
  modified_base (20)..(21): 2'-methoxy-nucleotide
gggccccggcgaggccggguu

SEQ ID NO: 243 - RNA, 21 nt, Artificial Sequence
  Description of Artificial Sequence: Synthetic oligonucleotide
  modified_base (20)..(21): 2'-methoxy-nucleotide
ggccccggcgaggccgggauu

SEQ ID NO: 244 - RNA, 21 nt, Artificial Sequence
  Description of Artificial Sequence: Synthetic oligonucleotide
  modified_base (20)..(21): 2'-methoxy-nucleotide
gccccggcgaggccgggauuu

SEQ ID NO: 245 - RNA, 21 nt, Artificial Sequence
  Description of Artificial Sequence: Synthetic oligonucleotide
  modified_base (20)..(21): 2'-methoxy-nucleotide
ccccggcgaggccgggauguu

SEQ ID NO: 246 - RNA, 21 nt, Artificial Sequence
  Description of Artificial Sequence: Synthetic oligonucleotide
  modified_base (20)..(21): 2'-methoxy-nucleotide
cccggcgaggccgggaugauu

SEQ ID NO: 247 - RNA, 21 nt, Artificial Sequence
  Description of Artificial Sequence: Synthetic oligonucleotide
  modified_base (20)..(21): 2'-methoxy-nucleotide
ccggcgaggccgggaugaguu

SEQ ID NO: 248 - RNA, 21 nt, Artificial Sequence
  Description of Artificial Sequence: Synthetic oligonucleotide
  modified_base (20)..(21): 2'-methoxy-nucleotide
cggcgaggccgggaugaguuu

SEQ ID NO: 249 - RNA, 21 nt, Artificial Sequence
  Description of Artificial Sequence: Synthetic oligonucleotide
  modified_base (20)..(21): 2'-methoxy-nucleotide
ggcgaggccgggaugaguuuu

SEQ ID NO: 250 - RNA, 21 nt, Artificial Sequence
  Description of Artificial Sequence: Synthetic oligonucleotide
  modified_base (20)..(21): 2'-methoxy-nucleotide
gcgaggccgggaugaguuguu

SEQ ID NO: 251 - RNA, 21 nt, Artificial Sequence
  Description of Artificial Sequence: Synthetic oligonucleotide
  modified_base (20)..(21): 2'-methoxy-nucleotide
cgaggccgggaugaguugguu

SEQ ID NO: 252 - RNA, 21 nt, Artificial Sequence
  Description of Artificial Sequence: Synthetic oligonucleotide
  modified_base (20)..(21): 2'-methoxy-nucleotide
gaggccgggaugaguuggguu

SEQ ID NO: 253 - RNA, 21 nt, Artificial Sequence
  Description of Artificial Sequence: Synthetic oligonucleotide
  modified_base (20)..(21): 2'-methoxy-nucleotide
aggccgggaugaguugggauu

SEQ ID NO: 254 - RNA, 21 nt, Artificial Sequence
  Description of Artificial Sequence: Synthetic oligonucleotide
  modified_base (20)..(21): 2'-methoxy-nucleotide
ggccgggaugaguugggaguu

SEQ ID NO: 255 - RNA, 21 nt, Artificial Sequence
  Description of Artificial Sequence: Synthetic oligonucleotide
  modified_base (20)..(21): 2'-methoxy-nucleotide
gccgggaugaguugggagguu

SEQ ID NO: 256 - RNA, 21 nt, Artificial Sequence
  Description of Artificial Sequence: Synthetic oligonucleotide
  modified_base (20)..(21): 2'-methoxy-nucleotide
ccgggaugaguugggaggauu

SEQ ID NO: 257 - RNA, 21 nt, Artificial Sequence
  Description of Artificial Sequence: Synthetic oligonucleotide
  modified_base (20)..(21): 2'-methoxy-nucleotide
cgggaugaguugggaggaguu

SEQ ID NO: 258 - RNA, 21 nt, Artificial Sequence
  Description of Artificial Sequence: Synthetic oligonucleotide
  modified_base (20)..(21): 2'-methoxy-nucleotide
gggaugaguugggaggagguu

SEQ ID NO: 259 - RNA, 21 nt, Artificial Sequence
  Description of Artificial Sequence: Synthetic oligonucleotide
  modified_base (20)..(21): 2'-methoxy-nucleotide
ggaugaguugggaggaggcuu

SEQ ID NO: 260 - RNA, 21 nt, Artificial Sequence
  Description of Artificial Sequence: Synthetic oligonucleotide
  modified_base (20)..(21): 2'-methoxy-nucleotide
gaugaguugggaggaggcauu

SEQ ID NO: 261 - RNA, 21 nt, Artificial Sequence
  Description of Artificial Sequence: Synthetic oligonucleotide
  modified_base (20)..(21): 2'-methoxy-nucleotide
augaguugggaggaggcaguu

SEQ ID NO: 262 - RNA, 21 nt, Artificial Sequence
  Description of Artificial Sequence: Synthetic oligonucleotide
  modified_base (20)..(21): 2'-methoxy-nucleotide
ugaguugggaggaggcagguu

SEQ ID NO: 263 - RNA, 21 nt, Artificial Sequence
  Description of Artificial Sequence: Synthetic oligonucleotide
  modified_base (20)..(21): 2'-methoxy-nucleotide
gaguugggaggaggcaggcuu

SEQ ID NO: 264 - RNA, 21 nt, Artificial Sequence
  Description of Artificial Sequence: Synthetic oligonucleotide
  modified_base (20)..(21): 2'-methoxy-nucleotide
aguugggaggaggcaggcguu

SEQ ID NO: 265 - RNA, 21 nt, Artificial Sequence
  Description of Artificial Sequence: Synthetic oligonucleotide
  modified_base (20)..(21): 2'-methoxy-nucleotide
guugggaggaggcaggcgguu

SEQ ID NO: 266 - RNA, 21 nt, Artificial Sequence
  Description of Artificial Sequence: Synthetic oligonucleotide
  modified_base (20)..(21): 2'-methoxy-nucleotide
uugggaggaggcaggcggcuu

SEQ ID NO: 267 - RNA, 21 nt, Artificial Sequence
  Description of Artificial Sequence: Synthetic oligonucleotide
  modified_base (20)..(21): 2'-methoxy-nucleotide
ugggaggaggcaggcggccuu

SEQ ID NO: 268 - RNA, 21 nt, Artificial Sequence
  Description of Artificial Sequence: Synthetic oligonucleotide
  modified_base (20)..(21): 2'-methoxy-nucleotide
gggaggaggcaggcggccuuu

SEQ ID NO: 269 - RNA, 21 nt, Artificial Sequence
  Description of Artificial Sequence: Synthetic oligonucleotide
  modified_base (20)..(21): 2'-methoxy-nucleotide
ggaggaggcaggcggccuguu

SEQ ID NO: 270 - RNA, 21 nt, Artificial Sequence
  Description of Artificial Sequence: Synthetic oligonucleotide
  modified_base (20)..(21): 2'-methoxy-nucleotide
gaggaggcaggcggccugguu

SEQ ID NO: 271 - RNA, 21 nt, Artificial Sequence
  Description of Artificial Sequence: Synthetic oligonucleotide
  modified_base (20)..(21): 2'-methoxy-nucleotide
aggaggcaggcggccuggcuu

SEQ ID NO: 272 - RNA, 21 nt, Artificial Sequence
  Description of Artificial Sequence: Synthetic oligonucleotide
  modified_base (20)..(21): 2'-methoxy-nucleotide
ggaggcaggcggccuggcauu

SEQ ID NO: 273 - RNA, 21 nt, Artificial Sequence
  Description of Artificial Sequence: Synthetic oligonucleotide
  modified_base (20)..(21): 2'-methoxy-nucleotide
gaggcaggcggccuggcacuu

SEQ ID NO: 274 - RNA, 21 nt, Artificial Sequence
  Description of Artificial Sequence: Synthetic oligonucleotide
  modified_base (20)..(21): 2'-methoxy-nucleotide
aggcaggcggccuggcaccuu

SEQ ID NO: 275 - RNA, 21 nt, Artificial Sequence
  Description of Artificial Sequence: Synthetic oligonucleotide
  modified_base (20)..(21): 2'-methoxy-nucleotide
ggcaggcggccuggcaccuuu

SEQ ID NO: 276 - RNA, 21 nt, Artificial Sequence
  Description of Artificial Sequence: Synthetic oligonucleotide
  modified_base (20)..(21): 2'-methoxy-nucleotide
gcaggcggccuggcaccucuu

SEQ ID NO: 277 - RNA, 21 nt, Artificial Sequence
  Description of Artificial Sequence: Synthetic oligonucleotide
  modified_base (20)..(21): 2'-methoxy-nucleotide
caggcggccuggcaccucauu

SEQ ID NO: 278 - RNA, 21 nt, Artificial Sequence
  Description of Artificial Sequence: Synthetic oligonucleotide
  modified_base (20)..(21): 2'-methoxy-nucleotide
aggcggccuggcaccucacuu

SEQ ID NO: 279 - RNA, 21 nt, Artificial Sequence
  Description of Artificial Sequence: Synthetic oligonucleotide
  modified_base (20)..(21): 2'-methoxy-nucleotide
ggcggccuggcaccucaccuu

SEQ ID NO: 280 - RNA, 21 nt, Artificial Sequence
  Description of Artificial Sequence: Synthetic oligonucleotide
  modified_base (20)..(21): 2'-methoxy-nucleotide
gcggccuggcaccucaccuuu

SEQ ID NO: 281 - RNA, 21 nt, Artificial Sequence
  Description of Artificial Sequence: Synthetic oligonucleotide
  modified_base (20)..(21): 2'-methoxy-nucleotide
cggccuggcaccucaccuguu

SEQ ID NO: 282 - RNA, 21 nt, Artificial Sequence
  Description of Artificial Sequence: Synthetic oligonucleotide
  modified_base (20)..(21): 2'-methoxy-nucleotide
ggccuggcaccucaccugcuu

SEQ ID NO: 283 - RNA, 21 nt, Artificial Sequence
  Description of Artificial Sequence: Synthetic oligonucleotide
  modified_base (20)..(21): 2'-methoxy-nucleotide
gccuggcaccucaccugcuuu

SEQ ID NO: 284 - RNA, 21 nt, Artificial Sequence
  Description of Artificial Sequence: Synthetic oligonucleotide
  modified_base (20)..(21): 2'-methoxy-nucleotide
ccuggcaccucaccugcucuu

SEQ ID NO: 285 - RNA, 21 nt, Artificial Sequence
  Description of Artificial Sequence: Synthetic oligonucleotide
  modified_base (20)..(21): 2'-methoxy-nucleotide
cuggcaccucaccugcucuuu

SEQ ID NO: 286 - RNA, 21 nt, Artificial Sequence
  Description of Artificial Sequence: Synthetic oligonucleotide
  modified_base (20)..(21): 2'-methoxy-nucleotide
uggcaccucaccugcucuguu

SEQ ID NO: 287 - RNA, 21 nt, Artificial Sequence
  Description of Artificial Sequence: Synthetic oligonucleotide
  modified_base (20)..(21): 2'-methoxy-nucleotide
ggcaccucaccugcucugcuu

SEQ ID NO: 288 - RNA, 21 nt, Artificial Sequence
  Description of Artificial Sequence: Synthetic oligonucleotide
  modified_base (20)..(21): 2'-methoxy-nucleotide
gcaccucaccugcucugcuuu

SEQ ID NO: 289 - RNA, 21 nt, Artificial Sequence
  Description of Artificial Sequence: Synthetic oligonucleotide
  modified_base (20)..(21): 2'-methoxy-nucleotide
caccucaccugcucugcuguu

SEQ ID NO: 290 - RNA, 21 nt, Artificial Sequence
  Description of Artificial Sequence: Synthetic oligonucleotide
  modified_base (20)..(21): 2'-methoxy-nucleotide
accucaccugcucugcugcuu

SEQ ID NO: 291 - RNA, 21 nt, Artificial Sequence
  Description of Artificial Sequence: Synthetic oligonucleotide
  modified_base (20)..(21): 2'-methoxy-nucleotide
ccucaccugcucugcugcauu

SEQ ID NO: 292 - RNA, 21 nt, Artificial Sequence
  Description of Artificial Sequence: Synthetic oligonucleotide
  modified_base (20)..(21): 2'-methoxy-nucleotide
cucaccugcucugcugcaguu

SEQ ID NO: 293 - RNA, 21 nt, Artificial Sequence
  Description of Artificial Sequence: Synthetic oligonucleotide
  modified_base (20)..(21): 2'-methoxy-nucleotide
ucaccugcucugcugcagguu

SEQ ID NO: 294 - RNA, 21 nt, Artificial Sequence
  Description of Artificial Sequence: Synthetic oligonucleotide
  modified_base (20)..(21): 2'-methoxy-nucleotide
caccugcucugcugcaggguu

SEQ ID NO: 295 - RNA, 21 nt, Artificial Sequence
  Description of Artificial Sequence: Synthetic oligonucleotide
  modified_base (20)..(21): 2'-methoxy-nucleotide
accugcucugcugcagggguu

SEQ ID NO: 296 - RNA, 21 nt, Artificial Sequence
  Description of Artificial Sequence: Synthetic oligonucleotide
  modified_base (20)..(21): 2'-methoxy-nucleotide
ccugcucugcugcaggggauu

SEQ ID NO: 297 - RNA, 21 nt, Artificial Sequence
  Description of Artificial Sequence: Synthetic oligonucleotide
  modified_base (20)..(21): 2'-methoxy-nucleotide
cugcucugcugcaggggacuu

SEQ ID NO: 298 - RNA, 21 nt, Artificial Sequence
  Description of Artificial Sequence: Synthetic oligonucleotide
  modified_base (20)..(21): 2'-methoxy-nucleotide
ugcucugcugcaggggacauu

SEQ ID NO: 299 - RNA, 21 nt, Artificial Sequence
  Description of Artificial Sequence: Synthetic oligonucleotide
  modified_base (20)..(21): 2'-methoxy-nucleotide
gcucugcugcaggggacaguu

SEQ ID NO: 300 - RNA, 21 nt, Artificial Sequence
  Description of Artificial Sequence: Synthetic oligonucleotide
  modified_base (20)..(21): 2'-methoxy-nucleotide
cucugcugcaggggacagcuu

SEQ ID NO: 301 - RNA, 21 nt, Artificial Sequence
  Description of Artificial Sequence: Synthetic oligonucleotide
  modified_base (20)..(21): 2'-methoxy-nucleotide
ucugcugcaggggacagcauu

SEQ ID NO: 302 - RNA, 21 nt, Artificial Sequence
  Description of Artificial Sequence: Synthetic oligonucleotide
  modified_base (20)..(21): 2'-methoxy-nucleotide
cugcugcaggggacagcaguu

SEQ ID NO: 303 - RNA, 21 nt, Artificial Sequence
  Description of Artificial Sequence: Synthetic oligonucleotide
  modified_base (20)..(21): 2'-methoxy-nucleotide
ugcugcaggggacagcagauu

SEQ ID NO: 304 - RNA, 21 nt, Artificial Sequence
  Description of Artificial Sequence: Synthetic oligonucleotide
  modified_base (20)..(21): 2'-methoxy-nucleotide
gcugcaggggacagcagaguu

SEQ ID NO: 305 - RNA, 21 nt, Artificial Sequence
  Description of Artificial Sequence: Synthetic oligonucleotide
  modified_base (20)..(21): 2'-methoxy-nucleotide
cugcaggggacagcagagguu

SEQ ID NO: 306 - RNA, 21 nt, Artificial Sequence
  Description of Artificial Sequence: Synthetic oligonucleotide
  modified_base (20)..(21): 2'-methoxy-nucleotide
ugcaggggacagcagaggauu

SEQ ID NO: 307 - RNA, 21 nt, Artificial Sequence
  Description of Artificial Sequence: Synthetic oligonucleotide
  modified_base (20)..(21): 2'-methoxy-nucleotide
gcaggggacagcagaggaauu

SEQ ID NO: 308 - RNA, 21 nt, Artificial Sequence
  Description of Artificial Sequence: Synthetic oligonucleotide
  modified_base (20)..(21): 2'-methoxy-nucleotide
caggggacagcagaggaaguu

SEQ ID NO: 309 - RNA, 21 nt, Artificial Sequence
  Description of Artificial Sequence: Synthetic oligonucleotide
  modified_base (20)..(21): 2'-methoxy-nucleotide
aggggacagcagaggaagauu

SEQ ID NO: 310 - RNA, 21 nt, Artificial Sequence
  Description of Artificial Sequence: Synthetic oligonucleotide
  modified_base (20)..(21): 2'-methoxy-nucleotide
ggggacagcagaggaagacuu

SEQ ID NO: 311 - RNA, 21 nt, Artificial Sequence
  Description of Artificial Sequence: Synthetic oligonucleotide
  modified_base (20)..(21): 2'-methoxy-nucleotide
gggacagcagaggaagaccuu

SEQ ID NO: 312 - RNA, 21 nt, Artificial Sequence
  Description of Artificial Sequence: Synthetic oligonucleotide
  modified_base (20)..(21): 2'-methoxy-nucleotide
ggacagcagaggaagaccauu

SEQ ID NO: 313 - RNA, 21 nt, Artificial Sequence
  Description of Artificial Sequence: Synthetic oligonucleotide
  modified_base (20)..(21): 2'-methoxy-nucleotide
gacagcagaggaagaccauuu

SEQ ID NO: 314 - RNA, 21 nt, Artificial Sequence
  Description of Artificial Sequence: Synthetic oligonucleotide
  modified_base (20)..(21): 2'-methoxy-nucleotide
acagcagaggaagaccauguu

SEQ ID NO: 315 - RNA, 21 nt, Artificial Sequence
  Description of Artificial Sequence: Synthetic oligonucleotide
  modified_base (20)..(21): 2'-methoxy-nucleotide
cagcagaggaagaccauguuu

SEQ ID NO: 316 - RNA, 21 nt, Artificial Sequence
  Description of Artificial Sequence: Synthetic oligonucleotide
  modified_base (20)..(21): 2'-methoxy-nucleotide
agcagaggaagaccauguguu

SEQ ID NO: 317 - RNA, 21 nt, Artificial Sequence
  Description of Artificial Sequence: Synthetic oligonucleotide
  modified_base (20)..(21): 2'-methoxy-nucleotide
gcagaggaagaccaugugguu

SEQ ID NO: 318 - RNA, 21 nt, Artificial Sequence
  Description of Artificial Sequence: Synthetic oligonucleotide
  modified_base (20)..(21): 2'-methoxy-nucleotide
cagaggaagaccauguggauu

SEQ ID NO: 319 - RNA, 21 nt, Artificial Sequence
  Description of Artificial Sequence: Synthetic oligonucleotide
  modified_base (20)..(21): 2'-methoxy-nucleotide
agaggaagaccauguggacuu

SEQ ID NO: 320 - RNA, 21 nt, Artificial Sequence
  Description of Artificial Sequence: Synthetic oligonucleotide
  modified_base (20)..(21): 2'-methoxy-nucleotide
gaggaagaccauguggaccuu

SEQ ID NO: 321 - RNA, 21 nt, Artificial Sequence
  Description of Artificial Sequence: Synthetic oligonucleotide
  modified_base (20)..(21): 2'-methoxy-nucleotide
aggaagaccauguggaccuuu

SEQ ID NO: 322 - RNA, 21 nt, Artificial Sequence
  Description of Artificial Sequence: Synthetic oligonucleotide
  modified_base (20)..(21): 2'-methoxy-nucleotide
ggaagaccauguggaccuguu

SEQ ID NO: 323 - RNA, 21 nt, Artificial Sequence
  Description of Artificial Sequence: Synthetic oligonucleotide
  modified_base (20)..(21): 2'-methoxy-nucleotide
gaagaccauguggaccuguuu

SEQ ID NO: 324 - RNA, 21 nt, Artificial Sequence
  Description of Artificial Sequence: Synthetic oligonucleotide
  modified_base (20)..(21): 2'-methoxy-nucleotide
aagaccauguggaccugucuu

SEQ ID NO: 325 - RNA, 21 nt, Artificial Sequence
  Description of Artificial Sequence: Synthetic oligonucleotide
  modified_base (20)..(21): 2'-methoxy-nucleotide
agaccauguggaccugucauu

SEQ ID NO: 326 - RNA, 21 nt, Artificial Sequence
  Description of Artificial Sequence: Synthetic oligonucleotide
  modified_base (20)..(21): 2'-methoxy-nucleotide
gaccauguggaccugucacuu

SEQ ID NO: 327 - RNA, 21 nt, Artificial Sequence
  Description of Artificial Sequence: Synthetic oligonucleotide
  modified_base (20)..(21): 2'-methoxy-nucleotide
accauguggaccugucacuuu

SEQ ID NO: 328 - RNA, 21 nt, Artificial Sequence
  Description of Artificial Sequence: Synthetic oligonucleotide
  modified_base (20)..(21): 2'-methoxy-nucleotide
ccauguggaccugucacuguu

SEQ ID NO: 329 - RNA, 21 nt, Artificial Sequence
  Description of Artificial Sequence: Synthetic oligonucleotide
  modified_base (20)..(21): 2'-methoxy-nucleotide
cauguggaccugucacuguuu

SEQ ID NO: 330 - RNA, 21 nt, Artificial Sequence
  Description of Artificial Sequence: Synthetic oligonucleotide
  modified_base (20)..(21): 2'-methoxy-nucleotide
auguggaccugucacugucuu

SEQ ID NO: 331 - RNA, 21 nt, Artificial Sequence
  Description of Artificial Sequence: Synthetic oligonucleotide
  modified_base (20)..(21): 2'-methoxy-nucleotide
uguggaccugucacugucuuu

SEQ ID NO: 332 - RNA, 21 nt, Artificial Sequence
  Description of Artificial Sequence: Synthetic oligonucleotide
  modified_base (20)..(21): 2'-methoxy-nucleotide
guggaccugucacugucuuuu

SEQ ID NO: 333 - RNA, 21 nt, Artificial Sequence
  Description of Artificial Sequence: Synthetic oligonucleotide
  modified_base (20)..(21): 2'-methoxy-nucleotide
uggaccugucacugucuuguu

SEQ ID NO: 334 - RNA, 21 nt, Artificial Sequence
  Description of Artificial Sequence: Synthetic oligonucleotide
  modified_base (20)..(21): 2'-methoxy-nucleotide
ggaccugucacugucuuguuu

SEQ ID NO: 335 - RNA, 21 nt, Artificial Sequence
  Description of Artificial Sequence: Synthetic oligonucleotide
  modified_base (20)..(21): 2'-methoxy-nucleotide
gaccugucacugucuuguauu

SEQ ID NO: 336 - RNA, 21 nt, Artificial Sequence
  Description of Artificial Sequence: Synthetic oligonucleotide
  modified_base (20)..(21): 2'-methoxy-nucleotide
accugucacugucuuguacuu

SEQ ID NO: 337 - RNA, 21 nt, Artificial Sequence
  Description of Artificial Sequence: Synthetic oligonucleotide
  modified_base (20)..(21): 2'-methoxy-nucleotide
ccugucacugucuuguaccuu

SEQ ID NO: 338 - RNA, 21 nt, Artificial Sequence
  Description of Artificial Sequence: Synthetic oligonucleotide
  modified_base (20)..(21): 2'-methoxy-nucleotide
cugucacugucuuguacccuu

SEQ ID NO: 339 - RNA, 21 nt, Artificial Sequence
  Description of Artificial Sequence: Synthetic oligonucleotide
  modified_base (20)..(21): 2'-methoxy-nucleotide
ugucacugucuuguacccuuu

SEQ ID NO: 340 - RNA, 21 nt, Artificial Sequence
  Description of Artificial Sequence: Synthetic oligonucleotide
  modified_base (20)..(21): 2'-methoxy-nucleotide
gucacugucuuguacccuuuu

SEQ ID NO: 341 - RNA, 21 nt, Artificial Sequence
  Description of Artificial Sequence: Synthetic oligonucleotide
  modified_base (20)..(21): 2'-methoxy-nucleotide
ucacugucuuguacccuuguu

SEQ ID NO: 342 - RNA, 21 nt, Artificial Sequence
  Description of Artificial Sequence: Synthetic oligonucleotide
  modified_base (20)..(21): 2'-methoxy-nucleotide
cacugucuuguacccuuguuu

SEQ ID NO: 343 - RNA, 21 nt, Artificial Sequence
  Description of Artificial Sequence: Synthetic oligonucleotide
  modified_base (20)..(21): 2'-methoxy-nucleotide
acugucuuguacccuuguguu

SEQ ID NO: 344 - RNA, 21 nt, Artificial Sequence
  Description of Artificial Sequence: Synthetic oligonucleotide
  modified_base (20)..(21): 2'-methoxy-nucleotide
cugucuuguacccuugugcuu

SEQ ID NO: 345 - RNA, 21 nt, Artificial Sequence
  Description of Artificial Sequence: Synthetic oligonucleotide
  modified_base (20)..(21): 2'-methoxy-nucleotide
ugucuuguacccuugugccuu

SEQ ID NO: 346 - RNA, 21 nt, Artificial Sequence
  Description of Artificial Sequence: Synthetic oligonucleotide
  modified_base (20)..(21): 2'-methoxy-nucleotide
gucuuguacccuugugccuuu

SEQ ID NO: 347 - RNA, 21 nt, Artificial Sequence
  Description of Artificial Sequence: Synthetic oligonucleotide
  modified_base (20)..(21): 2'-methoxy-nucleotide
ucuuguacccuugugccucuu

SEQ ID NO: 348 - RNA, 21 nt, Artificial Sequence
  Description of Artificial Sequence: Synthetic oligonucleotide
  modified_base (20)..(21): 2'-methoxy-nucleotide
cuuguacccuugugccucguu

SEQ ID NO: 349 - RNA, 21 nt, Artificial Sequence
  Description of Artificial Sequence: Synthetic oligonucleotide
  modified_base (20)..(21): 2'-methoxy-nucleotide
uuguacccuugugccucgcuu

SEQ ID NO: 350 - RNA, 21 nt, Artificial Sequence
  Description of Artificial Sequence: Synthetic oligonucleotide
  modified_base (20)..(21): 2'-methoxy-nucleotide
uguacccuugugccucgcuuu

SEQ ID NO: 351 - RNA, 21 nt, Artificial Sequence
  Description of Artificial Sequence: Synthetic oligonucleotide
  modified_base (20)..(21): 2'-methoxy-nucleotide
guacccuugugccucgcucuu

SEQ ID NO: 352 - RNA, 21 nt, Artificial Sequence
  Description of Artificial Sequence: Synthetic oligonucleotide
  modified_base (20)..(21): 2'-methoxy-nucleotide
uacccuugugccucgcucauu

SEQ ID NO: 353 - RNA, 21 nt, Artificial Sequence
  Description of Artificial Sequence: Synthetic oligonucleotide
  modified_base (20)..(21): 2'-methoxy-nucleotide
acccuugugccucgcucaguu

SEQ ID NO: 354 - RNA, 21 nt, Artificial Sequence
  Description of Artificial Sequence: Synthetic oligonucleotide
  modified_base (20)..(21): 2'-methoxy-nucleotide
cccuugugccucgcucagguu

SEQ ID NO: 355 - RNA, 21 nt, Artificial Sequence
  Description of Artificial Sequence: Synthetic oligonucleotide
  modified_base (20)..(21): 2'-methoxy-nucleotide
ccuugugccucgcucaggguu

SEQ ID NO: 356 - RNA, 21 nt, Artificial Sequence
  Description of Artificial Sequence: Synthetic oligonucleotide
  modified_base (20)..(21): 2'-methoxy-nucleotide
cuugugccucgcucagggguu

SEQ ID NO: 357 - RNA, 21 nt, Artificial Sequence
  Description of Artificial Sequence: Synthetic oligonucleotide
  modified_base (20)..(21): 2'-methoxy-nucleotide
uugugccucgcucaggggauu

SEQ ID NO: 358 - RNA, 21 nt, Artificial Sequence
  Description of Artificial Sequence: Synthetic oligonucleotide
  modified_base (20)..(21): 2'-methoxy-nucleotide
ugugccucgcucaggggaguu

SEQ ID NO: 359 - RNA, 21 nt, Artificial Sequence
  Description of Artificial Sequence: Synthetic oligonucleotide
  modified_base (20)..(21): 2'-methoxy-nucleotide
gugccucgcucaggggagcuu

SEQ ID NO: 360 - RNA, 21 nt, Artificial Sequence
  Description of Artificial Sequence: Synthetic oligonucleotide
  modified_base (20)..(21): 2'-methoxy-nucleotide
ugccucgcucaggggagcauu

SEQ ID NO: 361 - RNA, 21 nt, Artificial Sequence
  Description of Artificial Sequence: Synthetic oligonucleotide
  modified_base (20)..(21): 2'-methoxy-nucleotide
gccucgcucaggggagcaguu

SEQ ID NO: 362 - RNA, 21 nt, Artificial Sequence
  Description of Artificial Sequence: Synthetic oligonucleotide
  modified_base (20)..(21): 2'-methoxy-nucleotide
ccucgcucaggggagcagguu

SEQ ID NO: 363 - RNA, 21 nt, Artificial Sequence
  Description of Artificial Sequence: Synthetic oligonucleotide
  modified_base (20)..(21): 2'-methoxy-nucleotide
cucgcucaggggagcaggcuu

SEQ ID NO: 364 - RNA, 21 nt, Artificial Sequence
  Description of Artificial Sequence: Synthetic oligonucleotide
  modified_base (20)..(21): 2'-methoxy-nucleotide
ucgcucaggggagcaggcuuu

SEQ ID NO: 365 - RNA, 21 nt, Artificial Sequence
  Description of Artificial Sequence: Synthetic oligonucleotide
  modified_base (20)..(21): 2'-methoxy-nucleotide
cgcucaggggagcaggcuguu

SEQ ID NO: 366 - RNA, 21 nt, Artificial Sequence
  Description of Artificial Sequence: Synthetic oligonucleotide
  modified_base (20)..(21): 2'-methoxy-nucleotide
gcucaggggagcaggcugauu

SEQ ID NO: 367 - RNA, 21 nt, Artificial Sequence
  Description of Artificial Sequence: Synthetic oligonucleotide
  modified_base (20)..(21): 2'-methoxy-nucleotide
cucaggggagcaggcugaauu

SEQ ID NO: 368 - RNA, 21 nt, Artificial Sequence
  Description of Artificial Sequence: Synthetic oligonucleotide
  modified_base (20)..(21): 2'-methoxy-nucleotide
ucaggggagcaggcugaaguu

SEQ ID NO: 369 - RNA, 21 nt, Artificial Sequence
  Description of Artificial Sequence: Synthetic oligonucleotide
  modified_base (20)..(21): 2'-methoxy-nucleotide
caggggagcaggcugaagguu

SEQ ID NO: 370 - RNA, 21 nt, Artificial Sequence
  Description of Artificial Sequence: Synthetic oligonucleotide
  modified_base (20)..(21): 2'-methoxy-nucleotide
aggggagcaggcugaaggguu

SEQ ID NO: 371 - RNA, 21 nt, Artificial Sequence
  Description of Artificial Sequence: Synthetic oligonucleotide
  modified_base (20)..(21): 2'-methoxy-nucleotide
ggggagcaggcugaaggguuu

SEQ ID NO: 372 - RNA, 21 nt, Artificial Sequence
  Description of Artificial Sequence: Synthetic oligonucleotide
  modified_base (20)..(21): 2'-methoxy-nucleotide
gggagcaggcugaagggucuu

SEQ ID NO: 373 - RNA, 21 nt, Artificial Sequence
  Description of Artificial Sequence: Synthetic oligonucleotide
  modified_base (20)..(21): 2'-methoxy-nucleotide
ggagcaggcugaaggguccuu

SEQ ID NO: 374 - RNA, 21 nt, Artificial Sequence
  Description of Artificial Sequence: Synthetic oligonucleotide
  modified_base (20)..(21): 2'-methoxy-nucleotide
gagcaggcugaagggucccuu

SEQ ID NO: 375 - RNA, 21 nt, Artificial Sequence
  Description of Artificial Sequence: Synthetic oligonucleotide
  modified_base (20)..(21): 2'-methoxy-nucleotide
agcaggcugaaggguccccuu

SEQ ID NO: 376 - RNA, 21 nt, Artificial Sequence
  Description of Artificial Sequence: Synthetic oligonucleotide
  modified_base (20)..(21): 2'-methoxy-nucleotide
gcaggcugaaggguccccauu

SEQ ID NO: 377 - RNA, 21 nt, Artificial Sequence
  Description of Artificial Sequence: Synthetic oligonucleotide
  modified_base (20)..(21): 2'-methoxy-nucleotide
caggcugaaggguccccaguu

SEQ ID NO: 378 - RNA, 21 nt, Artificial Sequence
  Description of Artificial Sequence: Synthetic oligonucleotide
  modified_base (20)..(21): 2'-methoxy-nucleotide
aggcugaaggguccccagguu

SEQ ID NO: 379 - RNA, 21 nt, Artificial Sequence
  Description of Artificial Sequence: Synthetic oligonucleotide
  modified_base (20)..(21): 2'-methoxy-nucleotide
ggcugaaggguccccagguuu

SEQ ID NO: 380 - RNA, 21 nt, Artificial Sequence
  Description of Artificial Sequence: Synthetic oligonucleotide
  modified_base (20)..(21): 2'-methoxy-nucleotide
gcugaaggguccccagguguu

SEQ ID NO: 381 - RNA, 21 nt, Artificial Sequence
  Description of Artificial Sequence: Synthetic oligonucleotide
  modified_base (20)..(21): 2'-methoxy-nucleotide
cugaaggguccccaggugguu

SEQ ID NO: 382 - RNA, 21 nt, Artificial Sequence
  Description of Artificial Sequence: Synthetic oligonucleotide
  modified_base (20)..(21): 2'-methoxy-nucleotide
ugaaggguccccagguggauu

SEQ ID NO: 383 - RNA, 21 nt, Artificial Sequence
  Description of Artificial Sequence: Synthetic oligonucleotide
  modified_base (20)..(21): 2'-methoxy-nucleotide
gaaggguccccagguggacuu

SEQ ID NO: 384 - RNA, 21 nt, Artificial Sequence
  Description of Artificial Sequence: Synthetic oligonucleotide
  modified_base (20)..(21): 2'-methoxy-nucleotide
aaggguccccagguggaccuu

SEQ ID NO: 385 - RNA, 21 nt, Artificial Sequence
  Description of Artificial Sequence: Synthetic oligonucleotide
  modified_base (20)..(21): 2'-methoxy-nucleotide
aggguccccagguggaccuuu

SEQ ID NO: 386 - RNA, 21 nt, Artificial Sequence
  Description of Artificial Sequence: Synthetic oligonucleotide
  modified_base (20)..(21): 2'-methoxy-nucleotide
ggguccccagguggaccuguu

SEQ ID NO: 387 - RNA, 21 nt, Artificial Sequence
  Description of Artificial Sequence: Synthetic oligonucleotide
  modified_base (20)..(21): 2'-methoxy-nucleotide
gguccccagguggaccugguu

SEQ ID NO: 388 - RNA, 21 nt, Artificial Sequence
  Description of Artificial Sequence: Synthetic oligonucleotide
  modified_base (20)..(21): 2'-methoxy-nucleotide
guccccagguggaccuggauu

SEQ ID NO: 389 - RNA, 21 nt, Artificial Sequence
  Description of Artificial Sequence: Synthetic oligonucleotide
  modified_base (20)..(21): 2'-methoxy-nucleotide
uccccagguggaccuggaguu

SEQ ID NO: 390 - RNA, 21 nt, Artificial Sequence
  Description of Artificial Sequence: Synthetic oligonucleotide
  modified_base (20)..(21): 2'-methoxy-nucleotide
ccccagguggaccuggagauu

SEQ ID NO: 391 - RNA, 21 nt, Artificial Sequence
  Description of Artificial Sequence: Synthetic oligonucleotide
  modified_base (20)..(21): 2'-methoxy-nucleotide
cccagguggaccuggagacuu

SEQ ID NO: 392 - RNA, 21 nt, Artificial Sequence
  Description of Artificial Sequence: Synthetic oligonucleotide
  modified_base (20)..(21): 2'-methoxy-nucleotide
ccagguggaccuggagacuuu

SEQ ID NO: 393 - RNA, 21 nt, Artificial Sequence
  Description of Artificial Sequence: Synthetic oligonucleotide
  modified_base (20)..(21): 2'-methoxy-nucleotide
cagguggaccuggagacucuu

SEQ ID NO: 394 - RNA, 21 nt, Artificial Sequence
  Description of Artificial Sequence: Synthetic oligonucleotide
  modified_base (20)..(21): 2'-methoxy-nucleotide
agguggaccuggagacucuuu

SEQ ID NO: 395 - RNA, 21 nt, Artificial Sequence
  Description of Artificial Sequence: Synthetic oligonucleotide
  modified_base (20)..(21): 2'-methoxy-nucleotide
gguggaccuggagacucucuu

SEQ ID NO: 396 - RNA, 21 nt, Artificial Sequence
  Description of Artificial Sequence: Synthetic oligonucleotide
  modified_base (20)..(21): 2'-methoxy-nucleotide
guggaccuggagacucucauu

SEQ ID NO: 397 - RNA, 21 nt, Artificial Sequence
  Description of Artificial Sequence: Synthetic oligonucleotide
  modified_base (20)..(21): 2'-methoxy-nucleotide
uggaccuggagacucucaguu

SEQ ID NO: 398 - RNA, 21 nt, Artificial Sequence
  Description of Artificial Sequence: Synthetic oligonucleotide
  modified_base (20)..(21): 2'-methoxy-nucleotide
ggaccuggagacucucagguu

SEQ ID NO: 399 - RNA, 21 nt, Artificial Sequence
  Description of Artificial Sequence: Synthetic oligonucleotide
  modified_base (20)..(21): 2'-methoxy-nucleotide
gaccuggagacucucaggguu

SEQ ID NO: 400 - RNA, 21 nt, Artificial Sequence
  Description of Artificial Sequence: Synthetic oligonucleotide
  modified_base (20)..(21): 2'-methoxy-nucleotide
accuggagacucucaggguuu

SEQ ID NO: 401 - RNA, 21 nt, Artificial Sequence
  Description of Artificial Sequence: Synthetic oligonucleotide
  modified_base (20)..(21): 2'-methoxy-nucleotide
ccuggagacucucagggucuu

SEQ ID NO: 402 - RNA, 21 nt, Artificial Sequence
  Description of Artificial Sequence: Synthetic oligonucleotide
  modified_base (20)..(21): 2'-methoxy-nucleotide
cuggagacucucagggucguu

SEQ ID NO: 403 - RNA, 21 nt, Artificial Sequence
  Description of Artificial Sequence: Synthetic oligonucleotide
  modified_base (20)..(21): 2'-methoxy-nucleotide
uggagacucucagggucgauu

SEQ ID NO: 404 - RNA, 21 nt, Artificial Sequence
  Description of Artificial Sequence: Synthetic oligonucleotide
  modified_base (20)..(21): 2'-methoxy-nucleotide
ggagacucucagggucgaauu

SEQ ID NO: 405 - RNA, 21 nt, Artificial Sequence
  Description of Artificial Sequence: Synthetic oligonucleotide
  modified_base (20)..(21): 2'-methoxy-nucleotide
gagacucucagggucgaaauu

SEQ ID NO: 406 - RNA, 21 nt, Artificial Sequence
  Description of Artificial Sequence: Synthetic oligonucleotide
  modified_base (20)..(21): 2'-methoxy-nucleotide
agacucucagggucgaaaauu

SEQ ID NO: 407 - RNA, 21 nt, Artificial Sequence
  Description of Artificial Sequence: Synthetic oligonucleotide
  modified_base (20)..(21): 2'-methoxy-nucleotide
gacucucagggucgaaaacuu

SEQ ID NO: 408 - RNA, 21 nt, Artificial Sequence
  Description of Artificial Sequence: Synthetic oligonucleotide
  modified_base (20)..(21): 2'-methoxy-nucleotide
acucucagggucgaaaacguu

SEQ ID NO: 409 - RNA, 21 nt, Artificial Sequence
  Description of Artificial Sequence: Synthetic oligonucleotide
  modified_base (20)..(21): 2'-methoxy-nucleotide
cucucagggucgaaaacgguu

SEQ ID NO: 410 - RNA, 21 nt, Artificial Sequence
  Description of Artificial Sequence: Synthetic oligonucleotide
  modified_base (20)..(21): 2'-methoxy-nucleotide
ucucagggucgaaaacggcuu

SEQ ID NO: 411 - RNA, 21 nt, Artificial Sequence
  Description of Artificial Sequence: Synthetic oligonucleotide
  modified_base (20)..(21): 2'-methoxy-nucleotide
cucagggucgaaaacggcguu

SEQ ID NO: 412 - RNA, 21 nt, Artificial Sequence
  Description of Artificial Sequence: Synthetic oligonucleotide
  modified_base (20)..(21): 2'-methoxy-nucleotide
ucagggucgaaaacggcgguu

SEQ ID NO: 413 - RNA, 21 nt, Artificial Sequence
  Description of Artificial Sequence: Synthetic oligonucleotide
  modified_base (20)..(21): 2'-methoxy-nucleotide
cagggucgaaaacggcggcuu

SEQ ID NO: 414 - RNA, 21 nt, Artificial Sequence
  Description of Artificial Sequence: Synthetic oligonucleotide
  modified_base (20)..(21): 2'-methoxy-nucleotide
agggucgaaaacggcggcauu

SEQ ID NO: 415 - RNA, 21 nt, Artificial Sequence
  Description of Artificial Sequence: Synthetic oligonucleotide
  modified_base (20)..(21): 2'-methoxy-nucleotide
gggucgaaaacggcggcaguu

SEQ ID NO: 416 - RNA, 21 nt, Artificial Sequence
  Description of Artificial Sequence: Synthetic oligonucleotide
  modified_base (20)..(21): 2'-methoxy-nucleotide
ggucgaaaacggcggcagauu

SEQ ID NO: 417 - RNA, 21 nt, Artificial Sequence
  Description of Artificial Sequence: Synthetic oligonucleotide
  modified_base (20)..(21): 2'-methoxy-nucleotide
gucgaaaacggcggcagacuu

SEQ ID NO: 418 - RNA, 21 nt, Artificial Sequence
  Description of Artificial Sequence: Synthetic oligonucleotide
  modified_base (20)..(21): 2'-methoxy-nucleotide
ucgaaaacggcggcagaccuu

SEQ ID NO: 419 - RNA, 21 nt, Artificial Sequence
  Description of Artificial Sequence: Synthetic oligonucleotide
  modified_base (20)..(21): 2'-methoxy-nucleotide
cgaaaacggcggcagaccauu

SEQ ID NO: 420 - RNA, 21 nt, Artificial Sequence
  Description of Artificial Sequence: Synthetic oligonucleotide
  modified_base (20)..(21): 2'-methoxy-nucleotide
gaaaacggcggcagaccaguu

SEQ ID NO: 421 - RNA, 21 nt, Artificial Sequence
  Description of Artificial Sequence: Synthetic oligonucleotide
  modified_base (20)..(21): 2'-methoxy-nucleotide
aaaacggcggcagaccagcuu

SEQ ID NO: 422 - RNA, 21 nt, Artificial Sequence
  Description of Artificial Sequence: Synthetic oligonucleotide
  modified_base (20)..(21): 2'-methoxy-nucleotide
aaacggcggcagaccagcauu

SEQ ID NO: 423 - RNA, 21 nt, Artificial Sequence
  Description of Artificial Sequence: Synthetic oligonucleotide
  modified_base (20)..(21): 2'-methoxy-nucleotide
aacggcggcagaccagcauuu

SEQ ID NO: 424 - RNA, 21 nt, Artificial Sequence
  Description of Artificial Sequence: Synthetic oligonucleotide
  modified_base (20)..(21): 2'-methoxy-nucleotide
acggcggcagaccagcauguu

SEQ ID NO: 425 - RNA, 21 nt, Artificial Sequence
  Description of Artificial Sequence: Synthetic oligonucleotide
  modified_base (20)..(21): 2'-methoxy-nucleotide
cggcggcagaccagcaugauu

SEQ ID NO: 426 - RNA, 21 nt, Artificial Sequence
  Description of Artificial Sequence: Synthetic oligonucleotide
  modified_base (20)..(21): 2'-methoxy-nucleotide
ggcggcagaccagcaugacuu

SEQ ID NO: 427 - RNA, 21 nt, Artificial Sequence
  Description of Artificial Sequence: Synthetic oligonucleotide
  modified_base (20)..(21): 2'-methoxy-nucleotide
gcggcagaccagcaugacauu

SEQ ID NO: 428 - RNA, 21 nt, Artificial Sequence
  Description of Artificial Sequence: Synthetic oligonucleotide
  modified_base (20)..(21): 2'-methoxy-nucleotide
cggcagaccagcaugacaguu

SEQ ID NO: 429 - RNA, 21 nt, Artificial Sequence
  Description of Artificial Sequence: Synthetic oligonucleotide
  modified_base (20)..(21): 2'-methoxy-nucleotide
ggcagaccagcaugacagauu

SEQ ID NO: 430 - RNA, 21 nt, Artificial Sequence
  Description of Artificial Sequence: Synthetic oligonucleotide
  modified_base (20)..(21): 2'-methoxy-nucleotide
gcagaccagcaugacagauuu

SEQ ID NO: 431 - RNA, 21 nt, Artificial Sequence
  Description of Artificial Sequence: Synthetic oligonucleotide
  modified_base (20)..(21): 2'-methoxy-nucleotide
cagaccagcaugacagauuuu

SEQ ID NO: 432 - RNA, 21 nt, Artificial Sequence
  Description of Artificial Sequence: Synthetic oligonucleotide
  modified_base (20)..(21): 2'-methoxy-nucleotide
agaccagcaugacagauuuuu

SEQ ID NO: 433 - RNA, 21 nt, Artificial Sequence
  Description of Artificial Sequence: Synthetic oligonucleotide
  modified_base (20)..(21): 2'-methoxy-nucleotide
gaccagcaugacagauuucuu

SEQ ID NO: 434 - RNA, 21 nt, Artificial Sequence
  Description of Artificial Sequence: Synthetic oligonucleotide
  modified_base (20)..(21): 2'-methoxy-nucleotide
accagcaugacagauuucuuu

SEQ ID NO: 435 - RNA, 21 nt, Artificial Sequence
  Description of Artificial Sequence: Synthetic oligonucleotide
  modified_base (20)..(21): 2'-methoxy-nucleotide
ccagcaugacagauuucuauu

SEQ ID NO: 436 - RNA, 21 nt, Artificial Sequence
  Description of Artificial Sequence: Synthetic oligonucleotide
  modified_base (20)..(21): 2'-methoxy-nucleotide
cagcaugacagauuucuacuu

SEQ ID NO: 437 - RNA, 21 nt, Artificial Sequence
  Description of Artificial Sequence: Synthetic oligonucleotide
  modified_base (20)..(21): 2'-methoxy-nucleotide
agcaugacagauuucuaccuu

SEQ ID NO: 438 - RNA, 21 nt, Artificial Sequence
  Description of Artificial Sequence: Synthetic oligonucleotide
  modified_base (20)..(21): 2'-methoxy-nucleotide
gcaugacagauuucuaccauu

SEQ ID NO: 439 - RNA, 21 nt, Artificial Sequence
  Description of Artificial Sequence: Synthetic oligonucleotide
  modified_base (20)..(21): 2'-methoxy-nucleotide
caugacagauuucuaccacuu

SEQ ID NO: 440 - RNA, 21 nt, Artificial Sequence
  Description of Artificial Sequence: Synthetic oligonucleotide
  modified_base (20)..(21): 2'-methoxy-nucleotide
augacagauuucuaccacuuu

SEQ ID NO: 441 - RNA, 21 nt, Artificial Sequence
  Description of Artificial Sequence: Synthetic oligonucleotide
  modified_base (20)..(21): 2'-methoxy-nucleotide
ugacagauuucuaccacucuu

SEQ ID NO: 442 - RNA, 21 nt, Artificial Sequence
  Description of Artificial Sequence: Synthetic oligonucleotide
  modified_base (20)..(21): 2'-methoxy-nucleotide
gacagauuucuaccacuccuu

SEQ ID NO: 443 - RNA, 21 nt, Artificial Sequence
  Description of Artificial Sequence: Synthetic oligonucleotide
  modified_base (20)..(21): 2'-methoxy-nucleotide
acagauuucuaccacuccauu

SEQ ID NO: 444 - RNA, 21 nt, Artificial Sequence
  Description of Artificial Sequence: Synthetic oligonucleotide
  modified_base (20)..(21): 2'-methoxy-nucleotide
cagauuucuaccacuccaauu

SEQ ID NO: 445 - RNA, 21 nt, Artificial Sequence
  Description of Artificial Sequence: Synthetic oligonucleotide
  modified_base (20)..(21): 2'-methoxy-nucleotide
agauuucuaccacuccaaauu

SEQ ID NO: 446 - RNA, 21 nt, Artificial Sequence
  Description of Artificial Sequence: Synthetic oligonucleotide
  modified_base (20)..(21): 2'-methoxy-nucleotide
gauuucuaccacuccaaacuu

SEQ ID NO: 447 - RNA, 21 nt, Artificial Sequence
  Description of Artificial Sequence: Synthetic oligonucleotide
  modified_base (20)..(21): 2'-methoxy-nucleotide
auuucuaccacuccaaacguu

SEQ ID NO: 448 - RNA, 21 nt, Artificial Sequence
  Description of Artificial Sequence: Synthetic oligonucleotide
  modified_base (20)..(21): 2'-methoxy-nucleotide
uuucuaccacuccaaacgcuu

SEQ ID NO: 449 - RNA, 21 nt, Artificial Sequence
  Description of Artificial Sequence: Synthetic oligonucleotide
  modified_base (20)..(21): 2'-methoxy-nucleotide
uucuaccacuccaaacgccuu

SEQ ID NO: 450 - RNA, 21 nt, Artificial Sequence
  Description of Artificial Sequence: Synthetic oligonucleotide
  modified_base (20)..(21): 2'-methoxy-nucleotide
ucuaccacuccaaacgccguu

SEQ ID NO: 451 - RNA, 21 nt, Artificial Sequence
  Description of Artificial Sequence: Synthetic oligonucleotide
  modified_base (20)..(21): 2'-methoxy-nucleotide
cuaccacuccaaacgccgguu

SEQ ID NO: 452 - RNA, 21 nt, Artificial Sequence
  Description of Artificial Sequence: Synthetic oligonucleotide
  modified_base (20)..(21): 2'-methoxy-nucleotide
uaccacuccaaacgccggcuu

SEQ ID NO: 453 - RNA, 21 nt, Artificial Sequence
  Description of Artificial Sequence: Synthetic oligonucleotide
  modified_base (20)..(21): 2'-methoxy-nucleotide
accacuccaaacgccggcuuu

SEQ ID NO: 454 - RNA, 21 nt, Artificial Sequence
  Description of Artificial Sequence: Synthetic oligonucleotide
  modified_base (20)..(21): 2'-methoxy-nucleotide
ccacuccaaacgccggcuguu

SEQ ID NO: 455 - RNA, 21 nt, Artificial Sequence
  Description of Artificial Sequence: Synthetic oligonucleotide
  modified_base (20)..(21): 2'-methoxy-nucleotide
cacuccaaacgccggcugauu

SEQ ID NO: 456 - RNA, 21 nt, Artificial Sequence
  Description of Artificial Sequence: Synthetic oligonucleotide
  modified_base (20)..(21): 2'-methoxy-nucleotide
acuccaaacgccggcugauuu

SEQ ID NO: 457 - RNA, 21 nt, Artificial Sequence
  Description of Artificial Sequence: Synthetic oligonucleotide
  modified_base (20)..(21): 2'-methoxy-nucleotide
cuccaaacgccggcugaucuu

SEQ ID NO: 458 - RNA, 21 nt, Artificial Sequence
  Description of Artificial Sequence: Synthetic oligonucleotide
  modified_base (20)..(21): 2'-methoxy-nucleotide
uccaaacgccggcugaucuuu

SEQ ID NO: 459 - RNA, 21 nt, Artificial Sequence
  Description of Artificial Sequence: Synthetic oligonucleotide
  modified_base (20)..(21): 2'-methoxy-nucleotide
ccaaacgccggcugaucuuuu

SEQ ID NO: 460 - RNA, 21 nt, Artificial Sequence
  Description of Artificial Sequence: Synthetic oligonucleotide
  modified_base (20)..(21): 2'-methoxy-nucleotide
caaacgccggcugaucuucuu

SEQ ID NO: 461 - RNA, 21 nt, Artificial Sequence
  Description of Artificial Sequence: Synthetic oligonucleotide
  modified_base (20)..(21): 2'-methoxy-nucleotide
aaacgccggcugaucuucuuu

SEQ ID NO: 462 - RNA, 21 nt, Artificial Sequence
  Description of Artificial Sequence: Synthetic oligonucleotide
  modified_base (20)..(21): 2'-methoxy-nucleotide
aacgccggcugaucuucucuu

SEQ ID NO: 463 - RNA, 21 nt, Artificial Sequence
  Description of Artificial Sequence: Synthetic oligonucleotide
  modified_base (20)..(21): 2'-methoxy-nucleotide
acgccggcugaucuucuccuu

SEQ ID NO: 464 - RNA, 21 nt, Artificial Sequence
  Description of Artificial Sequence: Synthetic oligonucleotide
  modified_base (20)..(21): 2'-methoxy-nucleotide
cgccggcugaucuucuccauu

SEQ ID NO: 465 - RNA, 21 nt, Artificial Sequence
  Description of Artificial Sequence: Synthetic oligonucleotide
  modified_base (20)..(21): 2'-methoxy-nucleotide
gccggcugaucuucuccaauu

SEQ ID NO: 466 - RNA, 21 nt, Artificial Sequence
  Description of Artificial Sequence: Synthetic oligonucleotide
  modified_base (20)..(21): 2'-methoxy-nucleotide
ccggcugaucuucuccaaguu

SEQ ID NO: 467 - RNA, 21 nt, Artificial Sequence
  Description of Artificial Sequence: Synthetic oligonucleotide
  modified_base (20)..(21): 2'-methoxy-nucleotide
cggcugaucuucuccaagauu

SEQ ID NO: 468 - RNA, 21 nt, Artificial Sequence
  Description of Artificial Sequence: Synthetic oligonucleotide
  modified_base (20)..(21): 2'-methoxy-nucleotide
ggcugaucuucuccaagaguu

SEQ ID NO: 469 - RNA, 21 nt, Artificial Sequence
  Description of Artificial Sequence: Synthetic oligonucleotide
  modified_base (20)..(21): 2'-methoxy-nucleotide
gcugaucuucuccaagagguu

SEQ ID NO: 470 - RNA, 21 nt, Artificial Sequence
  Description of Artificial Sequence: Synthetic oligonucleotide
  modified_base (20)..(21): 2'-methoxy-nucleotide
cugaucuucuccaagaggauu

SEQ ID NO: 471 - RNA, 21 nt, Artificial Sequence
  Description of Artificial Sequence: Synthetic oligonucleotide
  modified_base (20)..(21): 2'-methoxy-nucleotide
ugaucuucuccaagaggaauu

SEQ ID NO: 472 - RNA, 21 nt, Artificial Sequence
  Description of Artificial Sequence: Synthetic oligonucleotide
  modified_base (20)..(21): 2'-methoxy-nucleotide
gaucuucuccaagaggaaguu

SEQ ID NO: 473 - RNA, 21 nt, Artificial Sequence
  Description of Artificial Sequence: Synthetic oligonucleotide
  modified_base (20)..(21): 2'-methoxy-nucleotide
aucuucuccaagaggaagcuu

SEQ ID NO: 474 - RNA, 21 nt, Artificial Sequence
  Description of Artificial Sequence: Synthetic oligonucleotide
  modified_base (20)..(21): 2'-methoxy-nucleotide
ucuucuccaagaggaagccuu

SEQ ID NO: 475 - RNA, 21 nt, Artificial Sequence
  Description of Artificial Sequence: Synthetic oligonucleotide
  modified_base (20)..(21): 2'-methoxy-nucleotide
cuucuccaagaggaagcccuu

SEQ ID NO: 476 - RNA, 21 nt, Artificial Sequence
  Description of Artificial Sequence: Synthetic oligonucleotide
  modified_base (20)..(21): 2'-methoxy-nucleotide
uucuccaagaggaagcccuuu

SEQ ID NO: 477 - RNA, 21 nt, Artificial Sequence
  Description of Artificial Sequence: Synthetic oligonucleotide
  modified_base (20)..(21): 2'-methoxy-nucleotide
ucuccaagaggaagcccuauu

SEQ ID NO: 478 - RNA, 21 nt, Artificial Sequence
  Description of Artificial Sequence: Synthetic oligonucleotide
  modified_base (20)..(21): 2'-methoxy-nucleotide
cuccaagaggaagcccuaauu

SEQ ID NO: 479 - RNA, 21 nt, Artificial Sequence
  Description of Artificial Sequence: Synthetic oligonucleotide
  modified_base (20)..(21): 2'-methoxy-nucleotide
uccaagaggaagcccuaauuu

SEQ ID NO: 480 - RNA, 21 nt, Artificial Sequence
  Description of Artificial Sequence: Synthetic oligonucleotide
  modified_base (20)..(21): 2'-methoxy-nucleotide
ccaagaggaagcccuaaucuu

SEQ ID NO: 481 - RNA, 21 nt, Artificial Sequence
  Description of Artificial Sequence: Synthetic oligonucleotide
  modified_base (20)..(21): 2'-methoxy-nucleotide
caagaggaagcccuaauccuu

SEQ ID NO: 482 - RNA, 21 nt, Artificial Sequence
  Description of Artificial Sequence: Synthetic oligonucleotide
  modified_base (20)..(21): 2'-methoxy-nucleotide
aagaggaagcccuaauccguu

SEQ ID NO: 483 - RNA, 21 nt, Artificial Sequence
  Description of Artificial Sequence: Synthetic oligonucleotide
  modified_base (20)..(21): 2'-methoxy-nucleotide
agaggaagcccuaauccgcuu

SEQ ID NO: 484 - RNA, 21 nt, Artificial Sequence
  Description of Artificial Sequence: Synthetic oligonucleotide
  modified_base (20)..(21): 2'-methoxy-nucleotide
gaggaagcccuaauccgccuu

SEQ ID NO: 485 - RNA, 21 nt, Artificial Sequence
  Description of Artificial Sequence: Synthetic oligonucleotide
  modified_base (20)..(21): 2'-methoxy-nucleotide
aggaagcccuaauccgcccuu

SEQ ID NO: 486 - RNA, 21 nt, Artificial Sequence
  Description of Artificial Sequence: Synthetic oligonucleotide
  modified_base (20)..(21): 2'-methoxy-nucleotide
ggaagcccuaauccgcccauu

SEQ ID NO: 487 - RNA, 21 nt, Artificial Sequence
  Description of Artificial Sequence: Synthetic oligonucleotide
  modified_base (20)..(21): 2'-methoxy-nucleotide
gaagcccuaauccgcccacuu

SEQ ID NO: 488 - RNA, 21 nt, Artificial Sequence
  Description of Artificial Sequence: Synthetic oligonucleotide
  modified_base (20)..(21): 2'-methoxy-nucleotide
aagcccuaauccgcccacauu

SEQ ID NO: 489 - RNA, 21 nt, Artificial Sequence
  Description of Artificial Sequence: Synthetic oligonucleotide
  modified_base (20)..(21): 2'-methoxy-nucleotide
agcccuaauccgcccacaguu

SEQ ID NO: 490 - RNA, 21 nt, Artificial Sequence
  Description of Artificial Sequence: Synthetic oligonucleotide
  modified_base (20)..(21): 2'-methoxy-nucleotide
gcccuaauccgcccacagguu

SEQ ID NO: 491 - RNA, 21 nt, Artificial Sequence
  Description of Artificial Sequence: Synthetic oligonucleotide
  modified_base (20)..(21): 2'-methoxy-nucleotide
cccuaauccgcccacaggauu

SEQ ID NO: 492 - RNA, 21 nt, Artificial Sequence
  Description of Artificial Sequence: Synthetic oligonucleotide
  modified_base (20)..(21): 2'-methoxy-nucleotide
ccuaauccgcccacaggaauu

SEQ ID NO: 493 - RNA, 21 nt, Artificial Sequence
  Description of Artificial Sequence: Synthetic oligonucleotide
  modified_base (20)..(21): 2'-methoxy-nucleotide
cuaauccgcccacaggaaguu

SEQ ID NO: 494 - RNA, 21 nt, Artificial Sequence
  Description of Artificial Sequence: Synthetic oligonucleotide
  modified_base (20)..(21): 2'-methoxy-nucleotide
uaauccgcccacaggaagcuu

SEQ ID NO: 495 - RNA, 21 nt, Artificial Sequence
  Description of Artificial Sequence: Synthetic oligonucleotide
  modified_base (20)..(21): 2'-methoxy-nucleotide
aauccgcccacaggaagccuu

SEQ ID NO: 496 - RNA, 21 nt, Artificial Sequence
  Description of Artificial Sequence: Synthetic oligonucleotide
  modified_base (20)..(21): 2'-methoxy-nucleotide
auccgcccacaggaagccuuu

SEQ ID NO: 497 - RNA, 21 nt, Artificial Sequence
  Description of Artificial Sequence: Synthetic oligonucleotide
  modified_base (20)..(21): 2'-methoxy-nucleotide
uccgcccacaggaagccuguu

SEQ ID NO: 498 - RNA, 21 nt, Artificial Sequence
  Description of Artificial Sequence: Synthetic oligonucleotide
  modified_base (20)..(21): 2'-methoxy-nucleotide
ccgcccacaggaagccugcuu

SEQ ID NO: 499 - RNA, 21 nt, Artificial Sequence
  Description of Artificial Sequence: Synthetic oligonucleotide
  modified_base (20)..(21): 2'-methoxy-nucleotide
cgcccacaggaagccugcauu

SEQ ID NO: 500 - RNA, 21 nt, Artificial Sequence
  Description of Artificial Sequence: Synthetic oligonucleotide
  modified_base (20)..(21): 2'-methoxy-nucleotide
gcccacaggaagccugcaguu

SEQ ID NO: 501 - RNA, 21 nt, Artificial Sequence
  Description of Artificial Sequence: Synthetic oligonucleotide
  modified_base (20)..(21): 2'-methoxy-nucleotide
cccacaggaagccugcaguuu

SEQ ID NO: 502 - RNA, 21 nt, Artificial Sequence
  Description of Artificial Sequence: Synthetic oligonucleotide
  modified_base (20)..(21): 2'-methoxy-nucleotide
ccacaggaagccugcagucuu

SEQ ID NO: 503 - RNA, 21 nt, Artificial Sequence
  Description of Artificial Sequence: Synthetic oligonucleotide
  modified_base (20)..(21): 2'-methoxy-nucleotide
cacaggaagccugcaguccuu

SEQ ID NO: 504 - RNA, 21 nt, Artificial Sequence
  Description of Artificial Sequence: Synthetic oligonucleotide
  modified_base (20)..(21): 2'-methoxy-nucleotide
acaggaagccugcaguccuuu

SEQ ID NO: 505 - RNA, 21 nt, Artificial Sequence
  Description of Artificial Sequence: Synthetic oligonucleotide
  modified_base (20)..(21): 2'-methoxy-nucleotide
caggaagccugcaguccuguu

SEQ ID NO: 506 - RNA, 21 nt, Artificial Sequence
  Description of Artificial Sequence: Synthetic oligonucleotide
  modified_base (20)..(21): 2'-methoxy-nucleotide
aggaagccugcaguccugguu

SEQ ID NO: 507 - RNA, 21 nt, Artificial Sequence
  Description of Artificial Sequence: Synthetic oligonucleotide
  modified_base (20)..(21): 2'-methoxy-nucleotide
ggaagccugcaguccuggauu

SEQ ID NO: 508 - RNA, 21 nt, Artificial Sequence
  Description of Artificial Sequence: Synthetic oligonucleotide
  modified_base (20)..(21): 2'-methoxy-nucleotide
gaagccugcaguccuggaauu

SEQ ID NO: 509 - RNA, 21 nt, Artificial Sequence
  Description of Artificial Sequence: Synthetic oligonucleotide
  modified_base (20)..(21): 2'-methoxy-nucleotide
aagccugcaguccuggaaguu

SEQ ID NO: 510 - RNA, 21 nt, Artificial Sequence
  Description of Artificial Sequence: Synthetic oligonucleotide
  modified_base (20)..(21): 2'-methoxy-nucleotide
agccugcaguccuggaagcuu

SEQ ID NO: 511 - RNA, 21 nt, Artificial Sequence
  Description of Artificial Sequence: Synthetic oligonucleotide
  modified_base (20)..(21): 2'-methoxy-nucleotide
gccugcaguccuggaagcguu

SEQ ID NO: 512 - RNA, 21 nt, Artificial Sequence
  Description of Artificial Sequence: Synthetic oligonucleotide
  modified_base (20)..(21): 2'-methoxy-nucleotide
ccugcaguccuggaagcgcuu

SEQ ID NO: 513 - RNA, 21 nt, Artificial Sequence
  Description of Artificial Sequence: Synthetic oligonucleotide
  modified_base (20)..(21): 2'-methoxy-nucleotide
cugcaguccuggaagcgcguu

SEQ ID NO: 514 - RNA, 21 nt, Artificial Sequence
  Description of Artificial Sequence: Synthetic oligonucleotide
  modified_base (20)..(21): 2'-methoxy-nucleotide
ugcaguccuggaagcgcgauu

SEQ ID NO: 515 - RNA, 21 nt, Artificial Sequence
  Description of Artificial Sequence: Synthetic oligonucleotide
  modified_base (20)..(21): 2'-methoxy-nucleotide
gcaguccuggaagcgcgaguu

SEQ ID NO: 516 - RNA, 21 nt, Artificial Sequence
  Description of Artificial Sequence: Synthetic oligonucleotide
  modified_base (20)..(21): 2'-methoxy-nucleotide
caguccuggaagcgcgagguu

SEQ ID NO: 517 - RNA, 21 nt, Artificial Sequence
  Description of Artificial Sequence: Synthetic oligonucleotide
  modified_base (20)..(21): 2'-methoxy-nucleotide
aguccuggaagcgcgaggguu

SEQ ID NO: 518 - RNA, 21 nt, Artificial Sequence
  Description of Artificial Sequence: Synthetic oligonucleotide
  modified_base (20)..(21): 2'-methoxy-nucleotide
guccuggaagcgcgagggcuu

SEQ ID NO: 519 - RNA, 21 nt, Artificial Sequence
  Description of Artificial Sequence: Synthetic oligonucleotide
  modified_base (20)..(21): 2'-methoxy-nucleotide
uccuggaagcgcgagggccuu

SEQ ID NO: 520 - RNA, 21 nt, Artificial Sequence
  Description of Artificial Sequence: Synthetic oligonucleotide
  modified_base (20)..(21): 2'-methoxy-nucleotide
ccuggaagcgcgagggccuuu

SEQ ID NO: 521 - RNA, 21 nt, Artificial Sequence
  Description of Artificial Sequence: Synthetic oligonucleotide
  modified_base (20)..(21): 2'-methoxy-nucleotide
cuggaagcgcgagggccucuu

SEQ ID NO: 522 - RNA, 21 nt, Artificial Sequence
  Description of Artificial Sequence: Synthetic oligonucleotide
  modified_base (20)..(21): 2'-methoxy-nucleotide
uggaagcgcgagggccucauu

SEQ ID NO: 523 - RNA, 21 nt, Artificial Sequence
  Description of Artificial Sequence: Synthetic oligonucleotide
  modified_base (20)..(21): 2'-methoxy-nucleotide
ggaagcgcgagggccucaauu

SEQ ID NO: 524 - RNA, 21 nt, Artificial Sequence
  Description of Artificial Sequence: Synthetic oligonucleotide
  modified_base (20)..(21): 2'-methoxy-nucleotide
gaagcgcgagggccucaaauu

SEQ ID NO: 525 - RNA, 21 nt, Artificial Sequence
  Description of Artificial Sequence: Synthetic oligonucleotide
  modified_base (20)..(21): 2'-methoxy-nucleotide
aagcgcgagggccucaaaguu

SEQ ID NO: 526 - RNA, 21 nt, Artificial Sequence
  Description of Artificial Sequence: Synthetic oligonucleotide
  modified_base (20)..(21): 2'-methoxy-nucleotide
agcgcgagggccucaaagguu

SEQ ID NO: 527 - RNA, 21 nt, Artificial Sequence
  Description of Artificial Sequence: Synthetic oligonucleotide
  modified_base (20)..(21): 2'-methoxy-nucleotide
gcgcgagggccucaaaggcuu

SEQ ID NO: 528 - RNA, 21 nt, Artificial Sequence
  Description of Artificial Sequence: Synthetic oligonucleotide
  modified_base (20)..(21): 2'-methoxy-nucleotide
cgcgagggccucaaaggccuu

SEQ ID NO: 529 - RNA, 21 nt, Artificial Sequence
  Description of Artificial Sequence: Synthetic oligonucleotide
  modified_base (20)..(21): 2'-methoxy-nucleotide
gcgagggccucaaaggcccuu

SEQ ID NO: 530 - RNA, 21 nt, Artificial Sequence
  Description of Artificial Sequence: Synthetic oligonucleotide
  modified_base (20)..(21): 2'-methoxy-nucleotide
cgagggccucaaaggcccguu

SEQ ID NO: 531 - RNA, 21 nt, Artificial Sequence
  Description of Artificial Sequence: Synthetic oligonucleotide
  modified_base (20)..(21): 2'-methoxy-nucleotide
gagggccucaaaggcccgcuu

SEQ ID NO: 532 - RNA, 21 nt, Artificial Sequence
  Description of Artificial Sequence: Synthetic oligonucleotide
  modified_base (20)..(21): 2'-methoxy-nucleotide
agggccucaaaggcccgcuuu

SEQ ID NO: 533 - RNA, 21 nt, Artificial Sequence
  Description of Artificial Sequence: Synthetic oligonucleotide
  modified_base (20)..(21): 2'-methoxy-nucleotide
gggccucaaaggcccgcucuu

SEQ ID NO: 534 - RNA, 21 nt, Artificial Sequence
  Description of Artificial Sequence: Synthetic oligonucleotide
  modified_base (20)..(21): 2'-methoxy-nucleotide
ggccucaaaggcccgcucuuu

SEQ ID NO: 535 - RNA, 21 nt, Artificial Sequence
  Description of Artificial Sequence: Synthetic oligonucleotide
  modified_base (20)..(21): 2'-methoxy-nucleotide
gccucaaaggcccgcucuauu

SEQ ID NO: 536 - RNA, 21 nt, Artificial Sequence
  Description of Artificial Sequence: Synthetic oligonucleotide
  modified_base (20)..(21): 2'-methoxy-nucleotide
ccucaaaggcccgcucuacuu

SEQ ID NO: 537 - RNA, 21 nt, Artificial Sequence
  Description of Artificial Sequence: Synthetic oligonucleotide
  modified_base (20)..(21): 2'-methoxy-nucleotide
cucaaaggcccgcucuacauu

SEQ ID NO: 538 - RNA, 21 nt, Artificial Sequence
  Description of Artificial Sequence: Synthetic oligonucleotide
  modified_base (20)..(21): 2'-methoxy-nucleotide
ucaaaggcccgcucuacauuu

SEQ ID NO: 539 - RNA, 21 nt, Artificial Sequence
  Description of Artificial Sequence: Synthetic oligonucleotide
  modified_base (20)..(21): 2'-methoxy-nucleotide
caaaggcccgcucuacaucuu

SEQ ID NO: 540 - RNA, 21 nt, Artificial Sequence
  Description of Artificial Sequence: Synthetic oligonucleotide
  modified_base (20)..(21): 2'-methoxy-nucleotide
aaaggcccgcucuacaucuuu

SEQ ID NO: 541 - RNA, 21 nt, Artificial Sequence
  Description of Artificial Sequence: Synthetic oligonucleotide
  modified_base (20)..(21): 2'-methoxy-nucleotide
aaggcccgcucuacaucuuuu

SEQ ID NO: 542 - RNA, 21 nt, Artificial Sequence
  Description of Artificial Sequence: Synthetic oligonucleotide
  modified_base (20)..(21): 2'-methoxy-nucleotide
aggcccgcucuacaucuucuu

SEQ ID NO: 543 - RNA, 21 nt, Artificial Sequence
  Description of Artificial Sequence: Synthetic oligonucleotide
  modified_base (20)..(21): 2'-methoxy-nucleotide
ggcccgcucuacaucuucuuu

SEQ ID NO: 544 - RNA, 21 nt, Artificial Sequence
  Description of Artificial Sequence: Synthetic oligonucleotide
  modified_base (20)..(21): 2'-methoxy-nucleotide
gcccgcucuacaucuucuguu

SEQ ID NO: 545 - RNA, 21 nt, Artificial Sequence
  Description of Artificial Sequence: Synthetic oligonucleotide
  modified_base (20)..(21): 2'-methoxy-nucleotide
cccgcucuacaucuucugcuu

SEQ ID NO: 546 - RNA, 21 nt, Artificial Sequence
  Description of Artificial Sequence: Synthetic oligonucleotide
  modified_base (20)..(21): 2'-methoxy-nucleotide
ccgcucuacaucuucugccuu

SEQ ID NO: 547 - RNA, 21 nt, Artificial Sequence
  Description of Artificial Sequence: Synthetic oligonucleotide
  modified_base (20)..(21): 2'-methoxy-nucleotide
cgcucuacaucuucugccuuu

SEQ ID NO: 548 - RNA, 21 nt, Artificial Sequence
  Description of Artificial Sequence: Synthetic oligonucleotide
  modified_base (20)..(21): 2'-methoxy-nucleotide
gcucuacaucuucugccuuuu

SEQ ID NO: 549 - RNA, 21 nt, Artificial Sequence
  Description of Artificial Sequence: Synthetic oligonucleotide
  modified_base (20)..(21): 2'-methoxy-nucleotide
cucuacaucuucugccuuauu

SEQ ID NO: 550 - RNA, 21 nt, Artificial Sequence
  Description of Artificial Sequence: Synthetic oligonucleotide
  modified_base (20)..(21): 2'-methoxy-nucleotide
ucuacaucuucugccuuaguu

SEQ ID NO: 551 - RNA, 21 nt, Artificial Sequence
  Description of Artificial Sequence: Synthetic oligonucleotide
  modified_base (20)..(21): 2'-methoxy-nucleotide
cuacaucuucugccuuaguuu

SEQ ID NO: 552 - RNA, 21 nt, Artificial Sequence
  Description of Artificial Sequence: Synthetic oligonucleotide
  modified_base (20)..(21): 2'-methoxy-nucleotide
uacaucuucugccuuagucuu

SEQ ID NO: 553 - RNA, 21 nt, Artificial Sequence
  Description of Artificial Sequence: Synthetic oligonucleotide
  modified_base (20)..(21): 2'-methoxy-nucleotide
acaucuucugccuuagucuuu

SEQ ID NO: 554 - RNA, 21 nt, Artificial Sequence
  Description of Artificial Sequence: Synthetic oligonucleotide
  modified_base (20)..(21): 2'-methoxy-nucleotide
caucuucugccuuagucucuu

SEQ ID NO: 555 - RNA, 21 nt, Artificial Sequence
  Description of Artificial Sequence: Synthetic oligonucleotide
  modified_base (20)..(21): 2'-methoxy-nucleotide
aucuucugccuuagucucauu

SEQ ID NO: 556 - RNA, 21 nt, Artificial Sequence
  Description of Artificial Sequence: Synthetic oligonucleotide
  modified_base (20)..(21): 2'-methoxy-nucleotide
ucuucugccuuagucucaguu

SEQ ID NO: 557 - RNA, 21 nt, Artificial Sequence
  Description of Artificial Sequence: Synthetic oligonucleotide
  modified_base (20)..(21): 2'-methoxy-nucleotide
cuucugccuuagucucaguuu

SEQ ID NO: 558 - RNA, 21 nt, Artificial Sequence
  Description of Artificial Sequence: Synthetic oligonucleotide
  modified_base (20)..(21): 2'-methoxy-nucleotide
uucugccuuagucucaguuuu

SEQ ID NO: 559 - RNA, 21 nt, Artificial Sequence
  Description of Artificial Sequence: Synthetic oligonucleotide
  modified_base (20)..(21): 2'-methoxy-nucleotide
ucugccuuagucucaguuuuu

SEQ ID NO: 560 - RNA, 21 nt, Artificial Sequence
  Description of Artificial Sequence: Synthetic oligonucleotide
  modified_base (20)..(21): 2'-methoxy-nucleotide
cugccuuagucucaguuuguu

SEQ ID NO: 561 - RNA, 21 nt, Artificial Sequence
  Description of Artificial Sequence: Synthetic oligonucleotide
  modified_base (20)..(21): 2'-methoxy-nucleotide
ugccuuagucucaguuuguuu

SEQ ID NO: 562 - RNA, 21 nt, Artificial Sequence
  Description of Artificial Sequence: Synthetic oligonucleotide
  modified_base (20)..(21): 2'-methoxy-nucleotide
gccuuagucucaguuuguguu

SEQ ID NO: 563 - RNA, 21 nt, Artificial Sequence
  Description of Artificial Sequence: Synthetic oligonucleotide
  modified_base (20)..(21): 2'-methoxy-nucleotide
ccuuagucucaguuuguguuu

SEQ ID NO: 564 - RNA, 21 nt, Artificial Sequence
  Description of Artificial Sequence: Synthetic oligonucleotide
  modified_base (20)..(21): 2'-methoxy-nucleotide
cuuagucucaguuuguguguu

SEQ ID NO: 565 - RNA, 21 nt, Artificial Sequence
  Description of Artificial Sequence: Synthetic oligonucleotide
  modified_base (20)..(21): 2'-methoxy-nucleotide
uuagucucaguuuguguguuu

SEQ ID NO: 566 - RNA, 21 nt, Artificial Sequence
  Description of Artificial Sequence: Synthetic oligonucleotide
  modified_base (20)..(21): 2'-methoxy-nucleotide
uagucucaguuugugugucuu

SEQ ID NO: 567 - RNA, 21 nt, Artificial Sequence
  Description of Artificial Sequence: Synthetic oligonucleotide
  modified_base (20)..(21): 2'-methoxy-nucleotide
agucucaguuugugugucuuu

SEQ ID NO: 568 - RNA, 21 nt, Artificial Sequence
  Description of Artificial Sequence: Synthetic oligonucleotide
  modified_base (20)..(21): 2'-methoxy-nucleotide
gucucaguuugugugucuuuu

SEQ ID NO: 569 - RNA, 21 nt, Artificial Sequence
  Description of Artificial Sequence: Synthetic oligonucleotide
  modified_base (20)..(21): 2'-methoxy-nucleotide
ucucaguuugugugucuuauu

SEQ ID NO: 570 - RNA, 21 nt, Artificial Sequence
  Description of Artificial Sequence: Synthetic oligonucleotide
  modified_base (20)..(21): 2'-methoxy-nucleotide
cucaguuugugugucuuaauu

SEQ ID NO: 571 - RNA, 21 nt, Artificial Sequence
  Description of Artificial Sequence: Synthetic oligonucleotide
  modified_base (20)..(21): 2'-methoxy-nucleotide
ucaguuugugugucuuaauuu

SEQ ID NO: 572 - RNA, 21 nt, Artificial Sequence
  Description of Artificial Sequence: Synthetic oligonucleotide
  modified_base (20)..(21): 2'-methoxy-nucleotide
caguuugugugucuuaauuuu

SEQ ID NO: 573 - RNA, 21 nt, Artificial Sequence
  Description of Artificial Sequence: Synthetic oligonucleotide
  modified_base (20)..(21): 2'-methoxy-nucleotide
aguuugugugucuuaauuauu

SEQ ID NO: 574 - RNA, 21 nt, Artificial Sequence
  Description of Artificial Sequence: Synthetic oligonucleotide
  modified_base (20)..(21): 2'-methoxy-nucleotide
guuugugugucuuaauuauuu

SEQ ID NO: 575 - RNA, 21 nt, Artificial Sequence
  Description of Artificial Sequence: Synthetic oligonucleotide
  modified_base (20)..(21): 2'-methoxy-nucleotide
uuugugugucuuaauuauuuu

SEQ ID NO: 576 - RNA, 21 nt, Artificial Sequence
  Description of Artificial Sequence: Synthetic oligonucleotide
  modified_base (20)..(21): 2'-methoxy-nucleotide
uugugugucuuaauuauuauu

SEQ ID NO: 577 - RNA, 21 nt, Artificial Sequence
  Description of Artificial Sequence: Synthetic oligonucleotide
  modified_base (20)..(21): 2'-methoxy-nucleotide
ugugugucuuaauuauuauuu

SEQ ID NO: 578 - RNA, 21 nt, Artificial Sequence
  Description of Artificial Sequence: Synthetic oligonucleotide
  modified_base (20)..(21): 2'-methoxy-nucleotide
gugugucuuaauuauuauuuu

SEQ ID NO: 579 - RNA, 21 nt, Artificial Sequence
  Description of Artificial Sequence: Synthetic oligonucleotide
  modified_base (20)..(21): 2'-methoxy-nucleotide
ugugucuuaauuauuauuuuu

SEQ ID NO: 580 - RNA, 21 nt, Artificial Sequence
  Description of Artificial Sequence: Synthetic oligonucleotide
  modified_base (20)..(21): 2'-methoxy-nucleotide
gugucuuaauuauuauuuguu

SEQ ID NO: 581 - RNA, 21 nt, Artificial Sequence
  Description of Artificial Sequence: Synthetic oligonucleotide
  modified_base (20)..(21): 2'-methoxy-nucleotide
ugucuuaauuauuauuuguuu

SEQ ID NO: 582 - RNA, 21 nt, Artificial Sequence
  Description of Artificial Sequence: Synthetic oligonucleotide
  modified_base (20)..(21): 2'-methoxy-nucleotide
gucuuaauuauuauuuguguu

SEQ ID NO: 583 - RNA, 21 nt, Artificial Sequence
  Description of Artificial Sequence: Synthetic oligonucleotide
  modified_base (20)..(21): 2'-methoxy-nucleotide
ucuuaauuauuauuuguguuu

SEQ ID NO: 584 - RNA, 21 nt, Artificial Sequence
  Description of Artificial Sequence: Synthetic oligonucleotide
  modified_base (20)..(21): 2'-methoxy-nucleotide
cuuaauuauuauuuguguuuu

SEQ ID NO: 585 - RNA, 21 nt, Artificial Sequence
  Description of Artificial Sequence: Synthetic oligonucleotide
  modified_base (20)..(21): 2'-methoxy-nucleotide
uuaauuauuauuuguguuuuu

SEQ ID NO: 586 - RNA, 21 nt, Artificial Sequence
  Description of Artificial Sequence: Synthetic oligonucleotide
  modified_base (20)..(21): 2'-methoxy-nucleotide
uaauuauuauuuguguuuuuu

SEQ ID NO: 587 - RNA, 21 nt, Artificial Sequence
  Description of Artificial Sequence: Synthetic oligonucleotide
  modified_base (20)..(21): 2'-methoxy-nucleotide
aauuauuauuuguguuuuauu

SEQ ID NO: 588 - RNA, 21 nt, Artificial Sequence
  Description of Artificial Sequence: Synthetic oligonucleotide
  modified_base (20)..(21): 2'-methoxy-nucleotide
auuauuauuuguguuuuaauu

SEQ ID NO: 589 - RNA, 21 nt, Artificial Sequence
  Description of Artificial Sequence: Synthetic oligonucleotide
  modified_base (20)..(21): 2'-methoxy-nucleotide
uuauuauuuguguuuuaauuu

SEQ ID NO: 590 - RNA, 21 nt, Artificial Sequence
  Description of Artificial Sequence: Synthetic oligonucleotide
  modified_base (20)..(21): 2'-methoxy-nucleotide
uauuauuuguguuuuaauuuu

SEQ ID NO: 591 - RNA, 21 nt, Artificial Sequence
  Description of Artificial Sequence: Synthetic oligonucleotide
  modified_base (20)..(21): 2'-methoxy-nucleotide
auuauuuguguuuuaauuuuu

SEQ ID NO: 592 - RNA, 21 nt, Artificial Sequence
  Description of Artificial Sequence: Synthetic oligonucleotide
  modified_base (20)..(21): 2'-methoxy-nucleotide
uuauuuguguuuuaauuuauu

SEQ ID NO: 593 - RNA, 21 nt, Artificial Sequence
  Description of Artificial Sequence: Synthetic oligonucleotide
  modified_base (20)..(21): 2'-methoxy-nucleotide
uauuuguguuuuaauuuaauu

SEQ ID NO: 594 - RNA, 21 nt, Artificial Sequence
  Description of Artificial Sequence: Synthetic oligonucleotide
  modified_base (20)..(21): 2'-methoxy-nucleotide
auuuguguuuuaauuuaaauu

SEQ ID NO: 595 - RNA, 21 nt, Artificial Sequence
  Description of Artificial Sequence: Synthetic oligonucleotide
  modified_base (20)..(21): 2'-methoxy-nucleotide
uuuguguuuuaauuuaaacuu

SEQ ID NO: 596 - RNA, 21 nt, Artificial Sequence
  Description of Artificial Sequence: Synthetic oligonucleotide
  modified_base (20)..(21): 2'-methoxy-nucleotide
uuguguuuuaauuuaaacauu

SEQ ID NO: 597 - RNA, 21 nt, Artificial Sequence
  Description of Artificial Sequence: Synthetic oligonucleotide
  modified_base (20)..(21): 2'-methoxy-nucleotide
uguguuuuaauuuaaacacuu

SEQ ID NO: 598 - RNA, 21 nt, Artificial Sequence
  Description of Artificial Sequence: Synthetic oligonucleotide
  modified_base (20)..(21): 2'-methoxy-nucleotide
guguuuuaauuuaaacaccuu

SEQ ID NO: 599 - RNA, 21 nt, Artificial Sequence
  Description of Artificial Sequence: Synthetic oligonucleotide
  modified_base (20)..(21): 2'-methoxy-nucleotide
uguuuuaauuuaaacaccuuu

SEQ ID NO: 600 - RNA, 21 nt, Artificial Sequence
  Description of Artificial Sequence: Synthetic oligonucleotide
  modified_base (20)..(21): 2'-methoxy-nucleotide
guuuuaauuuaaacaccucuu

SEQ ID NO: 601 - RNA, 21 nt, Artificial Sequence
  Description of Artificial Sequence: Synthetic oligonucleotide
  modified_base (20)..(21): 2'-methoxy-nucleotide
uuuuaauuuaaacaccuccuu

SEQ ID NO: 602 - RNA, 21 nt, Artificial Sequence
  Description of Artificial Sequence: Synthetic oligonucleotide
  modified_base (20)..(21): 2'-methoxy-nucleotide
uuuaauuuaaacaccuccuuu

SEQ ID NO: 603 - RNA, 21 nt, Artificial Sequence
  Description of Artificial Sequence: Synthetic oligonucleotide
  modified_base (20)..(21): 2'-methoxy-nucleotide
uuaauuuaaacaccuccucuu

SEQ ID NO: 604 - RNA, 21 nt, Artificial Sequence
  Description of Artificial Sequence: Synthetic oligonucleotide
  modified_base (20)..(21): 2'-methoxy-nucleotide
uaauuuaaacaccuccucauu

SEQ ID NO: 605 - RNA, 21 nt, Artificial Sequence
  Description of Artificial Sequence: Synthetic oligonucleotide
  modified_base (20)..(21): 2'-methoxy-nucleotide
aauuuaaacaccuccucauuu

SEQ ID NO: 606 - RNA, 21 nt, Artificial Sequence
  Description of Artificial Sequence: Synthetic oligonucleotide
  modified_base (20)..(21): 2'-methoxy-nucleotide
auuuaaacaccuccucauguu

SEQ ID NO: 607 - RNA, 21 nt, Artificial Sequence
  Description of Artificial Sequence: Synthetic oligonucleotide
  modified_base (20)..(21): 2'-methoxy-nucleotide
uuuaaacaccuccucauguuu

SEQ ID NO: 608 - RNA, 21 nt, Artificial Sequence
  Description of Artificial Sequence: Synthetic oligonucleotide
  modified_base (20)..(21): 2'-methoxy-nucleotide
uuaaacaccuccucauguauu

SEQ ID NO: 609 - RNA, 21 nt, Artificial Sequence
  Description of Artificial Sequence: Synthetic oligonucleotide
  modified_base (20)..(21): 2'-methoxy-nucleotide
uaaacaccuccucauguacuu

SEQ ID NO: 610 - RNA, 21 nt, Artificial Sequence
  Description of Artificial Sequence: Synthetic oligonucleotide
  modified_base (20)..(21): 2'-methoxy-nucleotide
aaacaccuccucauguacauu

SEQ ID NO: 611 - RNA, 21 nt, Artificial Sequence
  Description of Artificial Sequence: Synthetic oligonucleotide
  modified_base (20)..(21): 2'-methoxy-nucleotide
aacaccuccucauguacauuu

SEQ ID NO: 612 - RNA, 21 nt, Artificial Sequence
  Description of Artificial Sequence: Synthetic oligonucleotide
  modified_base (20)..(21): 2'-methoxy-nucleotide
acaccuccucauguacauauu

SEQ ID NO: 613 - RNA, 21 nt, Artificial Sequence
  Description of Artificial Sequence: Synthetic oligonucleotide
  modified_base (20)..(21): 2'-methoxy-nucleotide
caccuccucauguacauacuu

SEQ ID NO: 614 - RNA, 21 nt, Artificial Sequence
  Description of Artificial Sequence: Synthetic oligonucleotide
  modified_base (20)..(21): 2'-methoxy-nucleotide
accuccucauguacauaccuu

SEQ ID NO: 615 - RNA, 21 nt, Artificial Sequence
  Description of Artificial Sequence: Synthetic oligonucleotide
  modified_base (20)..(21): 2'-methoxy-nucleotide
ccuccucauguacauacccuu

SEQ ID NO: 616 - RNA, 21 nt, Artificial Sequence
  Description of Artificial Sequence: Synthetic oligonucleotide
  modified_base (20)..(21): 2'-methoxy-nucleotide
cuccucauguacauacccuuu

SEQ ID NO: 617 - RNA, 21 nt, Artificial Sequence
  Description of Artificial Sequence: Synthetic oligonucleotide
  modified_base (20)..(21): 2'-methoxy-nucleotide
uccucauguacauacccuguu

SEQ ID NO: 618 - RNA, 21 nt, Artificial Sequence
  Description of Artificial Sequence: Synthetic oligonucleotide
  modified_base (20)..(21): 2'-methoxy-nucleotide
ccucauguacauacccugguu

SEQ ID NO: 619 - RNA, 21 nt, Artificial Sequence
  Description of Artificial Sequence: Synthetic oligonucleotide
  modified_base (20)..(21): 2'-methoxy-nucleotide
cucauguacauacccuggcuu

SEQ ID NO: 620 - RNA, 21 nt, Artificial Sequence
  Description of Artificial Sequence: Synthetic oligonucleotide
  modified_base (20)..(21): 2'-methoxy-nucleotide
ucauguacauacccuggccuu

SEQ ID NO: 621 - RNA, 21 nt, Artificial Sequence
  Description of Artificial Sequence: Synthetic oligonucleotide
  modified_base (20)..(21): 2'-methoxy-nucleotide
cauguacauacccuggccguu

SEQ ID NO: 622 - RNA, 21 nt, Artificial Sequence
  Description of Artificial Sequence: Synthetic oligonucleotide
  modified_base (20)..(21): 2'-methoxy-nucleotide
auguacauacccuggccgcuu

SEQ ID NO: 623 - RNA, 21 nt, Artificial Sequence
  Description of Artificial Sequence: Synthetic oligonucleotide
  modified_base (20)..(21): 2'-methoxy-nucleotide
uguacauacccuggccgccuu

SEQ ID NO: 624 - RNA, 21 nt, Artificial Sequence
  Description of Artificial Sequence: Synthetic oligonucleotide
  modified_base (20)..(21): 2'-methoxy-nucleotide
guacauacccuggccgcccuu

SEQ ID NO: 625 - RNA, 21 nt, Artificial Sequence
  Description of Artificial Sequence: Synthetic oligonucleotide
  modified_base (20)..(21): 2'-methoxy-nucleotide
uacauacccuggccgccccuu

SEQ ID NO: 626 - RNA, 21 nt, Artificial Sequence
  Description of Artificial Sequence: Synthetic oligonucleotide
  modified_base (20)..(21): 2'-methoxy-nucleotide
acauacccuggccgcccccuu

SEQ ID NO: 627 - RNA, 21 nt, Artificial Sequence
  Description of Artificial Sequence: Synthetic oligonucleotide
  modified_base (20)..(21): 2'-methoxy-nucleotide
cauacccuggccgcccccuuu

SEQ ID NO: 628 - RNA, 21 nt, Artificial Sequence
  Description of Artificial Sequence: Synthetic oligonucleotide
  modified_base (20)..(21): 2'-methoxy-nucleotide
auacccuggccgcccccuguu

SEQ ID NO: 629 - RNA, 21 nt, Artificial Sequence
  Description of Artificial Sequence: Synthetic oligonucleotide
  modified_base (20)..(21): 2'-methoxy-nucleotide
uacccuggccgcccccugcuu

SEQ ID NO: 630 - RNA, 21 nt, Artificial Sequence
  Description of Artificial Sequence: Synthetic oligonucleotide
  modified_base (20)..(21): 2'-methoxy-nucleotide
acccuggccgcccccugccuu

SEQ ID NO: 631 - RNA, 21 nt, Artificial Sequence
  Description of Artificial Sequence: Synthetic oligonucleotide
  modified_base (20)..(21): 2'-methoxy-nucleotide
cccuggccgcccccugcccuu

SEQ ID NO: 632 - RNA, 21 nt, Artificial Sequence
  Description of Artificial Sequence: Synthetic oligonucleotide
  modified_base (20)..(21): 2'-methoxy-nucleotide
ccuggccgcccccugccccuu

SEQ ID NO: 633 - RNA, 21 nt, Artificial Sequence
  Description of Artificial Sequence: Synthetic oligonucleotide
  modified_base (20)..(21): 2'-methoxy-nucleotide
cuggccgcccccugcccccuu

SEQ ID NO: 634 - RNA, 21 nt, Artificial Sequence
  Description of Artificial Sequence: Synthetic oligonucleotide
  modified_base (20)..(21): 2'-methoxy-nucleotide
uggccgcccccugccccccuu

SEQ ID NO: 635 - RNA, 21 nt, Artificial Sequence
  Description of Artificial Sequence: Synthetic oligonucleotide
  modified_base (20)..(21): 2'-methoxy-nucleotide
ggccgcccccugccccccauu

SEQ ID NO: 636 - RNA, 21 nt, Artificial Sequence
  Description of Artificial Sequence: Synthetic oligonucleotide
  modified_base (20)..(21): 2'-methoxy-nucleotide
gccgcccccugccccccaguu

SEQ ID NO: 637 - RNA, 21 nt, Artificial Sequence
  Description of Artificial Sequence: Synthetic oligonucleotide
  modified_base (20)..(21): 2'-methoxy-nucleotide
ccgcccccugccccccagcuu

SEQ ID NO: 638 - RNA, 21 nt, Artificial Sequence
  Description of Artificial Sequence: Synthetic oligonucleotide
  modified_base (20)..(21): 2'-methoxy-nucleotide
cgcccccugccccccagccuu

SEQ ID NO: 639 - RNA, 21 nt, Artificial Sequence
  Description of Artificial Sequence: Synthetic oligonucleotide
  modified_base (20)..(21): 2'-methoxy-nucleotide
gcccccugccccccagccuuu

SEQ ID NO: 640 - RNA, 21 nt, Artificial Sequence
  Description of Artificial Sequence: Synthetic oligonucleotide
  modified_base (20)..(21): 2'-methoxy-nucleotide
cccccugccccccagccucuu

SEQ ID NO: 641 - RNA, 21 nt, Artificial Sequence
  Description of Artificial Sequence: Synthetic oligonucleotide
  modified_base (20)..(21): 2'-methoxy-nucleotide
ccccugccccccagccucuuu

SEQ ID NO: 642 - RNA, 21 nt, Artificial Sequence
  Description of Artificial Sequence: Synthetic oligonucleotide
  modified_base (20)..(21): 2'-methoxy-nucleotide
cccugccccccagccucuguu

SEQ ID NO: 643 - RNA, 21 nt, Artificial Sequence
  Description of Artificial Sequence: Synthetic oligonucleotide
  modified_base (20)..(21): 2'-methoxy-nucleotide
ccugccccccagccucugguu

SEQ ID NO: 644 - RNA, 21 nt, Artificial Sequence
  Description of Artificial Sequence: Synthetic oligonucleotide
  modified_base (20)..(21): 2'-methoxy-nucleotide
cugccccccagccucuggcuu

SEQ ID NO: 645 - RNA, 21 nt, Artificial Sequence
  Description of Artificial Sequence: Synthetic oligonucleotide
  modified_base (20)..(21): 2'-methoxy-nucleotide
ugccccccagccucuggcauu

SEQ ID NO: 646 - RNA, 21 nt, Artificial Sequence
  Description of Artificial Sequence: Synthetic oligonucleotide
  modified_base (20)..(21): 2'-methoxy-nucleotide
gccccccagccucuggcauuu

SEQ ID NO: 647 - RNA, 21 nt, Artificial Sequence
  Description of Artificial Sequence: Synthetic oligonucleotide
  modified_base (20)..(21): 2'-methoxy-nucleotide
ccccccagccucuggcauuuu

SEQ ID NO: 648 - RNA, 21 nt, Artificial Sequence
  Description of Artificial Sequence: Synthetic oligonucleotide
  modified_base (20)..(21): 2'-methoxy-nucleotide
cccccagccucuggcauuauu

SEQ ID NO: 649 - RNA, 21 nt, Artificial Sequence
  Description of Artificial Sequence: Synthetic oligonucleotide
  modified_base (20)..(21): 2'-methoxy-nucleotide
ccccagccucuggcauuaguu

SEQ ID NO: 650 - RNA, 21 nt, Artificial Sequence
  Description of Artificial Sequence: Synthetic oligonucleotide
  modified_base (20)..(21): 2'-methoxy-nucleotide
cccagccucuggcauuagauu

SEQ ID NO: 651 - RNA, 21 nt, Artificial Sequence
  Description of Artificial Sequence: Synthetic oligonucleotide
  modified_base (20)..(21): 2'-methoxy-nucleotide
ccagccucuggcauuagaauu

SEQ ID NO: 652 - RNA, 21 nt, Artificial Sequence
  Description of Artificial Sequence: Synthetic oligonucleotide
  modified_base (20)..(21): 2'-methoxy-nucleotide
cagccucuggcauuagaauuu

SEQ ID NO: 653 - RNA, 21 nt, Artificial Sequence
  Description of Artificial Sequence: Synthetic oligonucleotide
  modified_base (20)..(21): 2'-methoxy-nucleotide
agccucuggcauuagaauuuu

SEQ ID NO: 654 - RNA, 21 nt, Artificial Sequence
  Description of Artificial Sequence: Synthetic oligonucleotide
  modified_base (20)..(21): 2'-methoxy-nucleotide
gccucuggcauuagaauuauu

SEQ ID NO: 655 - RNA, 21 nt, Artificial Sequence
  Description of Artificial Sequence: Synthetic oligonucleotide
  modified_base (20)..(21): 2'-methoxy-nucleotide
ccucuggcauuagaauuauuu

SEQ ID NO: 656 - RNA, 21 nt, Artificial Sequence
  Description of Artificial Sequence: Synthetic oligonucleotide
  modified_base (20)..(21): 2'-methoxy-nucleotide
cucuggcauuagaauuauuuu

SEQ ID NO: 657 - RNA, 21 nt, Artificial Sequence
  Description of Artificial Sequence: Synthetic oligonucleotide
  modified_base (20)..(21): 2'-methoxy-nucleotide
ucuggcauuagaauuauuuuu

SEQ ID NO: 658 - RNA, 21 nt, Artificial Sequence
  Description of Artificial Sequence: Synthetic oligonucleotide
  modified_base (20)..(21): 2'-methoxy-nucleotide
cuggcauuagaauuauuuauu

SEQ ID NO: 659 - RNA, 21 nt, Artificial Sequence
  Description of Artificial Sequence: Synthetic oligonucleotide
  modified_base (20)..(21): 2'-methoxy-nucleotide
uggcauuagaauuauuuaauu

SEQ ID NO: 660 - RNA, 21 nt, Artificial Sequence
  Description of Artificial Sequence: Synthetic oligonucleotide
  modified_base (20)..(21): 2'-methoxy-nucleotide
ggcauuagaauuauuuaaauu

SEQ ID NO: 661 - RNA, 21 nt, Artificial Sequence
  Description of Artificial Sequence: Synthetic oligonucleotide
  modified_base (20)..(21): 2'-methoxy-nucleotide
gcauuagaauuauuuaaacuu

SEQ ID NO: 662 - RNA, 21 nt, Artificial Sequence
  Description of Artificial Sequence: Synthetic oligonucleotide
  modified_base (20)..(21): 2'-methoxy-nucleotide
cauuagaauuauuuaaacauu

SEQ ID NO: 663 - RNA, 21 nt, Artificial Sequence
  Description of Artificial Sequence: Synthetic oligonucleotide
  modified_base (20)..(21): 2'-methoxy-nucleotide
auuagaauuauuuaaacaauu

SEQ ID NO: 664 - RNA, 21 nt, Artificial Sequence
  Description of Artificial Sequence: Synthetic oligonucleotide
  modified_base (20)..(21): 2'-methoxy-nucleotide
uuagaauuauuuaaacaaauu

SEQ ID NO: 665 - RNA, 21 nt, Artificial Sequence
  Description of Artificial Sequence: Synthetic oligonucleotide
  modified_base (20)..(21): 2'-methoxy-nucleotide
uagaauuauuuaaacaaaauu

SEQ ID NO: 666 - RNA, 21 nt, Artificial Sequence
  Description of Artificial Sequence: Synthetic oligonucleotide
  modified_base (20)..(21): 2'-methoxy-nucleotide
agaauuauuuaaacaaaaauu

SEQ ID NO: 667 - RNA, 21 nt, Artificial Sequence
  Description of Artificial Sequence: Synthetic oligonucleotide
  modified_base (20)..(21): 2'-methoxy-nucleotide
gaauuauuuaaacaaaaacuu

SEQ ID NO: 668 - RNA, 21 nt, Artificial Sequence
  Description of Artificial Sequence: Synthetic oligonucleotide
  modified_base (20)..(21): 2'-methoxy-nucleotide
aauuauuuaaacaaaaacuuu

SEQ ID NO: 669 - RNA, 21 nt, Artificial Sequence
  Description of Artificial Sequence: Synthetic oligonucleotide
  modified_base (20)..(21): 2'-methoxy-nucleotide
auuauuuaaacaaaaacuauu

SEQ ID NO: 670 - RNA, 21 nt, Artificial Sequence
  Description of Artificial Sequence: Synthetic oligonucleotide
  modified_base (20)..(21): 2'-methoxy-nucleotide
uuauuuaaacaaaaacuaguu

SEQ ID NO: 671 - RNA, 21 nt, Artificial Sequence
  Description of Artificial Sequence: Synthetic oligonucleotide
  modified_base (20)..(21): 2'-methoxy-nucleotide
uauuuaaacaaaaacuagguu

SEQ ID NO: 672 - RNA, 21 nt, Artificial Sequence
  Description of Artificial Sequence: Synthetic oligonucleotide
  modified_base (20)..(21): 2'-methoxy-nucleotide
auuuaaacaaaaacuaggcuu

SEQ ID NO: 673 - RNA, 21 nt, Artificial Sequence
  Description of Artificial Sequence: Synthetic oligonucleotide
  modified_base (20)..(21): 2'-methoxy-nucleotide
uuuaaacaaaaacuaggcguu

SEQ ID NO: 674 - RNA, 21 nt, Artificial Sequence
  Description of Artificial Sequence: Synthetic oligonucleotide
  modified_base (20)..(21): 2'-methoxy-nucleotide
uuaaacaaaaacuaggcgguu

SEQ ID NO: 675 - RNA, 21 nt, Artificial Sequence
  Description of Artificial Sequence: Synthetic oligonucleotide
  modified_base (20)..(21): 2'-methoxy-nucleotide
uaaacaaaaacuaggcgguuu

SEQ ID NO: 676 - RNA, 21 nt, Artificial Sequence
  Description of Artificial Sequence: Synthetic oligonucleotide
  modified_base (20)..(21): 2'-methoxy-nucleotide
aaacaaaaacuaggcgguuuu

SEQ ID NO: 677 - RNA, 21 nt, Artificial Sequence
  Description of Artificial Sequence: Synthetic oligonucleotide
  modified_base (20)..(21): 2'-methoxy-nucleotide
aacaaaaacuaggcgguuguu

SEQ ID NO: 678 - RNA, 21 nt, Artificial Sequence
  Description of Artificial Sequence: Synthetic oligonucleotide
  modified_base (20)..(21): 2'-methoxy-nucleotide
acaaaaacuaggcgguugauu

SEQ ID NO: 679 - RNA, 21 nt, Artificial Sequence
  Description of Artificial Sequence: Synthetic oligonucleotide
  modified_base (20)..(21): 2'-methoxy-nucleotide
caaaaacuaggcgguugaauu

SEQ ID NO: 680 - RNA, 21 nt, Artificial Sequence
  Description of Artificial Sequence: Synthetic oligonucleotide
  modified_base (20)..(21): 2'-methoxy-nucleotide
aaaaacuaggcgguugaauuu

SEQ ID NO: 681 - RNA, 21 nt, Artificial Sequence
  Description of Artificial Sequence: Synthetic oligonucleotide
  modified_base (20)..(21): 2'-methoxy-nucleotide
aaaacuaggcgguugaauguu

SEQ ID NO: 682 - RNA, 21 nt, Artificial Sequence
  Description of Artificial Sequence: Synthetic oligonucleotide
  modified_base (20)..(21): 2'-methoxy-nucleotide
aaacuaggcgguugaaugauu

SEQ ID NO: 683 - RNA, 21 nt, Artificial Sequence
  Description of Artificial Sequence: Synthetic oligonucleotide
  modified_base (20)..(21): 2'-methoxy-nucleotide
aacuaggcgguugaaugaguu

SEQ ID NO: 684 - RNA, 21 nt, Artificial Sequence
  Description of Artificial Sequence: Synthetic oligonucleotide
  modified_base (20)..(21): 2'-methoxy-nucleotide
acuaggcgguugaaugagauu

SEQ ID NO: 685 - RNA, 21 nt, Artificial Sequence
  Description of Artificial Sequence: Synthetic oligonucleotide
  modified_base (20)..(21): 2'-methoxy-nucleotide
cuaggcgguugaaugagaguu

SEQ ID NO: 686 - RNA, 21 nt, Artificial Sequence
  Description of Artificial Sequence: Synthetic oligonucleotide
  modified_base (20)..(21): 2'-methoxy-nucleotide
uaggcgguugaaugagagguu

SEQ ID NO: 687 - RNA, 21 nt, Artificial Sequence
  Description of Artificial Sequence: Synthetic oligonucleotide
  modified_base (20)..(21): 2'-methoxy-nucleotide
aggcgguugaaugagagguuu

SEQ ID NO: 688 - RNA, 21 nt, Artificial Sequence
  Description of Artificial Sequence: Synthetic oligonucleotide
  modified_base (20)..(21): 2'-methoxy-nucleotide
ggcgguugaaugagagguuuu

SEQ ID NO: 689 - RNA, 21 nt, Artificial Sequence
  Description of Artificial Sequence: Synthetic oligonucleotide
  modified_base (20)..(21): 2'-methoxy-nucleotide
gcgguugaaugagagguucuu

SEQ ID NO: 690 - RNA, 21 nt, Artificial Sequence
  Description of Artificial Sequence: Synthetic oligonucleotide
  modified_base (20)..(21): 2'-methoxy-nucleotide
cgguugaaugagagguuccuu

SEQ ID NO: 691 - RNA, 21 nt, Artificial Sequence
  Description of Artificial Sequence: Synthetic oligonucleotide
  modified_base (20)..(21): 2'-methoxy-nucleotide
gguugaaugagagguuccuuu

SEQ ID NO: 692 - RNA, 21 nt, Artificial Sequence
  Description of Artificial Sequence: Synthetic oligonucleotide
  modified_base (20)..(21): 2'-methoxy-nucleotide
guugaaugagagguuccuauu

SEQ ID NO: 693 - RNA, 21 nt, Artificial Sequence
  Description of Artificial Sequence: Synthetic oligonucleotide
  modified_base (20)..(21): 2'-methoxy-nucleotide
uugaaugagagguuccuaauu

SEQ ID NO: 694 - RNA, 21 nt, Artificial Sequence
  Description of Artificial Sequence: Synthetic oligonucleotide
  modified_base (20)..(21): 2'-methoxy-nucleotide
ugaaugagagguuccuaaguu

SEQ ID NO: 695 - RNA, 21 nt, Artificial Sequence
  Description of Artificial Sequence: Synthetic oligonucleotide
  modified_base (20)..(21): 2'-methoxy-nucleotide
gaaugagagguuccuaagauu

SEQ ID NO: 696 - RNA, 21 nt, Artificial Sequence
  Description of Artificial Sequence: Synthetic oligonucleotide
  modified_base (20)..(21): 2'-methoxy-nucleotide
aaugagagguuccuaagaguu

SEQ ID NO: 697 - RNA, 21 nt, Artificial Sequence
  Description of Artificial Sequence: Synthetic oligonucleotide
  modified_base (20)..(21): 2'-methoxy-nucleotide
augagagguuccuaagaguuu

SEQ ID NO: 698 - RNA, 21 nt, Artificial Sequence
  Description of Artificial Sequence: Synthetic oligonucleotide
  modified_base (20)..(21): 2'-methoxy-nucleotide
ugagagguuccuaagaguguu

SEQ ID NO: 699 - RNA, 21 nt, Artificial Sequence
  Description of Artificial Sequence: Synthetic oligonucleotide
  modified_base (20)..(21): 2'-methoxy-nucleotide
gagagguuccuaagagugcuu

SEQ ID NO: 700 - RNA, 21 nt, Artificial Sequence
  Description of Artificial Sequence: Synthetic oligonucleotide
  modified_base (20)..(21): 2'-methoxy-nucleotide
agagguuccuaagagugcuuu

SEQ ID NO: 701 - RNA, 21 nt, Artificial Sequence
  Description of Artificial Sequence: Synthetic oligonucleotide
  modified_base (20)..(21): 2'-methoxy-nucleotide
gagguuccuaagagugcuguu

SEQ ID NO: 702 - RNA, 21 nt, Artificial Sequence
  Description of Artificial Sequence: Synthetic oligonucleotide
  modified_base (20)..(21): 2'-methoxy-nucleotide
agguuccuaagagugcugguu

SEQ ID NO: 703 - RNA, 21 nt, Artificial Sequence
  Description of Artificial Sequence: Synthetic oligonucleotide
  modified_base (20)..(21): 2'-methoxy-nucleotide
gguuccuaagagugcuggguu

SEQ ID NO: 704 - RNA, 21 nt, Artificial Sequence
  Description of Artificial Sequence: Synthetic oligonucleotide
  modified_base (20)..(21): 2'-methoxy-nucleotide
guuccuaagagugcugggcuu

SEQ ID NO: 705 - RNA, 21 nt, Artificial Sequence
  Description of Artificial Sequence: Synthetic oligonucleotide
  modified_base (20)..(21): 2'-methoxy-nucleotide
uuccuaagagugcugggcauu

SEQ ID NO: 706 - RNA, 21 nt, Artificial Sequence
  Description of Artificial Sequence: Synthetic oligonucleotide
  modified_base (20)..(21): 2'-methoxy-nucleotide
ccuaagagugcugggcauuuu

SEQ ID NO: 707 - RNA, 21 nt, Artificial Sequence
  Description of Artificial Sequence: Synthetic oligonucleotide
  modified_base (20)..(21): 2'-methoxy-nucleotide
cuaagagugcugggcauuuuu

SEQ ID NO: 708 - RNA, 21 nt, Artificial Sequence
  Description of Artificial Sequence: Synthetic oligonucleotide
  modified_base (20)..(21): 2'-methoxy-nucleotide
uaagagugcugggcauuuuuu

SEQ ID NO: 709 - RNA, 21 nt, Artificial Sequence
  Description of Artificial Sequence: Synthetic oligonucleotide
  modified_base (20)..(21): 2'-methoxy-nucleotide
aagagugcugggcauuuuuuu

SEQ ID NO: 710 - RNA, 21 nt, Artificial Sequence
  Description of Artificial Sequence: Synthetic oligonucleotide
  modified_base (20)..(21): 2'-methoxy-nucleotide
agagugcugggcauuuuuauu

SEQ ID NO: 711 - RNA, 21 nt, Artificial Sequence
  Description of Artificial Sequence: Synthetic oligonucleotide
  modified_base (20)..(21): 2'-methoxy-nucleotide
gagugcugggcauuuuuauuu

SEQ ID NO: 712 - RNA, 21 nt, Artificial Sequence
  Description of Artificial Sequence: Synthetic oligonucleotide
  modified_base (20)..(21): 2'-methoxy-nucleotide
agugcugggcauuuuuauuuu

SEQ ID NO: 713 - RNA, 21 nt, Artificial Sequence
  Description of Artificial Sequence: Synthetic oligonucleotide
  modified_base (20)..(21): 2'-methoxy-nucleotide
gugcugggcauuuuuauuuuu

SEQ ID NO: 714 - RNA, 21 nt, Artificial Sequence
  Description of Artificial Sequence: Synthetic oligonucleotide
  modified_base (20)..(21): 2'-methoxy-nucleotide
ugcugggcauuuuuauuuuuu

SEQ ID NO: 715 - RNA, 21 nt, Artificial Sequence
  Description of Artificial Sequence: Synthetic oligonucleotide
  modified_base (20)..(21): 2'-methoxy-nucleotide
gcugggcauuuuuauuuuauu

SEQ ID NO: 716 - RNA, 21 nt, Artificial Sequence
  Description of Artificial Sequence: Synthetic oligonucleotide
  modified_base (20)..(21): 2'-methoxy-nucleotide
cugggcauuuuuauuuuauuu

SEQ ID NO: 717 - RNA, 21 nt, Artificial Sequence
  Description of Artificial Sequence: Synthetic oligonucleotide
  modified_base (20)..(21): 2'-methoxy-nucleotide
ugggcauuuuuauuuuauguu

SEQ ID NO: 718 - RNA, 21 nt, Artificial Sequence
  Description of Artificial Sequence: Synthetic oligonucleotide
  modified_base (20)..(21): 2'-methoxy-nucleotide
gggcauuuuuauuuuaugauu

SEQ ID NO: 719 - RNA, 21 nt, Artificial Sequence
  Description of Artificial Sequence: Synthetic oligonucleotide
  modified_base (20)..(21): 2'-methoxy-nucleotide
ggcauuuuuauuuuaugaauu

SEQ ID NO: 720 - RNA, 21 nt, Artificial Sequence
  Description of Artificial Sequence: Synthetic oligonucleotide
  modified_base (20)..(21): 2'-methoxy-nucleotide
gcauuuuuauuuuaugaaauu

SEQ ID NO: 721 - RNA, 21 nt, Artificial Sequence
  Description of Artificial Sequence: Synthetic oligonucleotide
  modified_base (20)..(21): 2'-methoxy-nucleotide
cauuuuuauuuuaugaaauuu

SEQ ID NO: 722 - RNA, 21 nt, Artificial Sequence
  Description of Artificial Sequence: Synthetic oligonucleotide
  modified_base (20)..(21): 2'-methoxy-nucleotide
auuuuuauuuuaugaaauauu

SEQ ID NO: 723 - RNA, 21 nt, Artificial Sequence
  Description of Artificial Sequence: Synthetic oligonucleotide
  modified_base (20)..(21): 2'-methoxy-nucleotide
uuuuuauuuuaugaaauacuu

SEQ ID NO: 724 - RNA, 21 nt, Artificial Sequence
  Description of Artificial Sequence: Synthetic oligonucleotide
  modified_base (20)..(21): 2'-methoxy-nucleotide
uuuuauuuuaugaaauacuuu

SEQ ID NO: 725 - RNA, 21 nt, Artificial Sequence
  Description of Artificial Sequence: Synthetic oligonucleotide
  modified_base (20)..(21): 2'-methoxy-nucleotide
uuuauuuuaugaaauacuauu

SEQ ID NO: 726 - RNA, 21 nt, Artificial Sequence
  Description of Artificial Sequence: Synthetic oligonucleotide
  modified_base (20)..(21): 2'-methoxy-nucleotide
uuauuuuaugaaauacuauuu

SEQ ID NO: 727 - RNA, 21 nt, Artificial Sequence
  Description of Artificial Sequence: Synthetic oligonucleotide
  modified_base (20)..(21): 2'-methoxy-nucleotide
uauuuuaugaaauacuauuuu

SEQ ID NO: 728 - RNA, 21 nt, Artificial Sequence
  Description of Artificial Sequence: Synthetic oligonucleotide
  modified_base (20)..(21): 2'-methoxy-nucleotide
auuuuaugaaauacuauuuuu

SEQ ID NO: 729 - RNA, 21 nt, Artificial Sequence
  Description of Artificial Sequence: Synthetic oligonucleotide
  modified_base (20)..(21): 2'-methoxy-nucleotide
uuuuaugaaauacuauuuauu

SEQ ID NO: 730 - RNA, 21 nt, Artificial Sequence
  Description of Artificial Sequence: Synthetic oligonucleotide
  modified_base (20)..(21): 2'-methoxy-nucleotide
uuuaugaaauacuauuuaauu

SEQ ID NO: 731 - RNA, 21 nt, Artificial Sequence
  Description of Artificial Sequence: Synthetic oligonucleotide
  modified_base (20)..(21): 2'-methoxy-nucleotide
uuaugaaauacuauuuaaauu

SEQ ID NO: 732 - RNA, 21 nt, Artificial Sequence
  Description of Artificial Sequence: Synthetic oligonucleotide
  modified_base (20)..(21): 2'-methoxy-nucleotide
uaugaaauacuauuuaaaguu

SEQ ID NO: 733 - RNA, 21 nt, Artificial Sequence
  Description of Artificial Sequence: Synthetic oligonucleotide
  modified_base (20)..(21): 2'-methoxy-nucleotide
augaaauacuauuuaaagcuu

SEQ ID NO: 734 - RNA, 21 nt, Artificial Sequence
  Description of Artificial Sequence: Synthetic oligonucleotide
  modified_base (20)..(21): 2'-methoxy-nucleotide
ugaaauacuauuuaaagccuu

SEQ ID NO: 735 - RNA, 21 nt, Artificial Sequence
  Description of Artificial Sequence: Synthetic oligonucleotide
  modified_base (20)..(21): 2'-methoxy-nucleotide
gaaauacuauuuaaagccuuu

SEQ ID NO: 736 - RNA, 21 nt, Artificial Sequence
  Description of Artificial Sequence: Synthetic oligonucleotide
  modified_base (20)..(21): 2'-methoxy-nucleotide
aaauacuauuuaaagccucuu

SEQ ID NO: 737 - RNA, 21 nt, Artificial Sequence
  Description of Artificial Sequence: Synthetic oligonucleotide
  modified_base (20)..(21): 2'-methoxy-nucleotide
aauacuauuuaaagccuccuu

SEQ ID NO: 738 - RNA, 21 nt, Artificial Sequence
  Description of Artificial Sequence: Synthetic oligonucleotide
  modified_base (20)..(21): 2'-methoxy-nucleotide
auacuauuuaaagccuccuuu

SEQ ID NO: 739 - RNA, 21 nt, Artificial Sequence
  Description of Artificial Sequence: Synthetic oligonucleotide
  modified_base (20)..(21): 2'-methoxy-nucleotide
uacuauuuaaagccuccucuu

SEQ ID NO: 740 - RNA, 21 nt, Artificial Sequence
  Description of Artificial Sequence: Synthetic oligonucleotide
  modified_base (20)..(21): 2'-methoxy-nucleotide
acuauuuaaagccuccucauu

SEQ ID NO: 741 - RNA, 21 nt, Artificial Sequence
  Description of Artificial Sequence: Synthetic oligonucleotide
  modified_base (20)..(21): 2'-methoxy-nucleotide
cuauuuaaagccuccucauuu

SEQ ID NO: 742 - RNA, 21 nt, Artificial Sequence
  Description of Artificial Sequence: Synthetic oligonucleotide
  modified_base (20)..(21): 2'-methoxy-nucleotide
uauuuaaagccuccucaucuu

SEQ ID NO: 743 - RNA, 21 nt, Artificial Sequence
  Description of Artificial Sequence: Synthetic oligonucleotide
  modified_base (20)..(21): 2'-methoxy-nucleotide
auuuaaagccuccucauccuu

SEQ ID NO: 744 - RNA, 21 nt, Artificial Sequence
  Description of Artificial Sequence: Synthetic oligonucleotide
  modified_base (20)..(21): 2'-methoxy-nucleotide
uuuaaagccuccucaucccuu

SEQ ID NO: 745 - RNA, 21 nt, Artificial Sequence
  Description of Artificial Sequence: Synthetic oligonucleotide
  modified_base (20)..(21): 2'-methoxy-nucleotide
uuaaagccuccucaucccguu

SEQ ID NO: 746 - RNA, 21 nt, Artificial Sequence
  Description of Artificial Sequence: Synthetic oligonucleotide
  modified_base (20)..(21): 2'-methoxy-nucleotide
uaaagccuccucaucccguuu

SEQ ID NO: 747 - RNA, 21 nt, Artificial Sequence
  Description of Artificial Sequence: Synthetic oligonucleotide
  modified_base (20)..(21): 2'-methoxy-nucleotide
aaagccuccucaucccguguu

SEQ ID NO: 748 - RNA, 21 nt, Artificial Sequence
  Description of Artificial Sequence: Synthetic oligonucleotide
  modified_base (20)..(21): 2'-methoxy-nucleotide
aagccuccucaucccguguuu

SEQ ID NO: 749 - RNA, 21 nt, Artificial Sequence
  Description of Artificial Sequence: Synthetic oligonucleotide
  modified_base (20)..(21): 2'-methoxy-nucleotide
agccuccucaucccguguuuu

SEQ ID NO: 750 - RNA, 21 nt, Artificial Sequence
  Description of Artificial Sequence: Synthetic oligonucleotide
  modified_base (20)..(21): 2'-methoxy-nucleotide
gccuccucaucccguguucuu

SEQ ID NO: 751 - RNA, 21 nt, Artificial Sequence
  Description of Artificial Sequence: Synthetic oligonucleotide
  modified_base (20)..(21): 2'-methoxy-nucleotide
ccuccucaucccguguucuuu

SEQ ID NO: 752 - RNA, 21 nt, Artificial Sequence
  Description of Artificial Sequence: Synthetic oligonucleotide
  modified_base (20)..(21): 2'-methoxy-nucleotide
cuccucaucccguguucucuu

SEQ ID NO: 753 - RNA, 21 nt, Artificial Sequence
  Description of Artificial Sequence: Synthetic oligonucleotide
  modified_base (20)..(21): 2'-methoxy-nucleotide
uccucaucccguguucuccuu

SEQ ID NO: 754 - RNA, 21 nt, Artificial Sequence
  Description of Artificial Sequence: Synthetic oligonucleotide
  modified_base (20)..(21): 2'-methoxy-nucleotide
ccucaucccguguucuccuuu

SEQ ID NO: 755 - RNA, 21 nt, Artificial Sequence
  Description of Artificial Sequence: Synthetic oligonucleotide
  modified_base (20)..(21): 2'-methoxy-nucleotide
cucaucccguguucuccuuuu

SEQ ID NO: 756 - RNA, 21 nt, Artificial Sequence
  Description of Artificial Sequence: Synthetic oligonucleotide
  modified_base (20)..(21): 2'-methoxy-nucleotide
ucaucccguguucuccuuuuu

SEQ ID NO: 757 - RNA, 21 nt, Artificial Sequence
  Description of Artificial Sequence: Synthetic oligonucleotide
  modified_base (20)..(21): 2'-methoxy-nucleotide
caucccguguucuccuuuuuu

SEQ ID NO: 758 - RNA, 21 nt, Artificial Sequence
  Description of Artificial Sequence: Synthetic oligonucleotide
  modified_base (20)..(21): 2'-methoxy-nucleotide
aucccguguucuccuuuucuu

SEQ ID NO: 759 - RNA, 21 nt, Artificial Sequence
  Description of Artificial Sequence: Synthetic oligonucleotide
  modified_base (20)..(21): 2'-methoxy-nucleotide
ucccguguucuccuuuuccuu

SEQ ID NO: 760 - RNA, 21 nt, Artificial Sequence
  Description of Artificial Sequence: Synthetic oligonucleotide
  modified_base (20)..(21): 2'-methoxy-nucleotide
cccguguucuccuuuuccuuu

SEQ ID NO: 761 - RNA, 21 nt, Artificial Sequence
  Description of Artificial Sequence: Synthetic oligonucleotide
  modified_base (20)..(21): 2'-methoxy-nucleotide
ccguguucuccuuuuccucuu

SEQ ID NO: 762 - RNA, 21 nt, Artificial Sequence
  Description of Artificial Sequence: Synthetic oligonucleotide
  modified_base (20)..(21): 2'-methoxy-nucleotide
cguguucuccuuuuccucuuu

SEQ ID NO: 763 - RNA, 21 nt, Artificial Sequence
  Description of Artificial Sequence: Synthetic oligonucleotide
  modified_base (20)..(21): 2'-methoxy-nucleotide
guguucuccuuuuccucucuu

SEQ ID NO: 764 - RNA, 21 nt, Artificial Sequence
  Description of Artificial Sequence: Synthetic oligonucleotide
  modified_base (20)..(21): 2'-methoxy-nucleotide
uguucuccuuuuccucucuuu

SEQ ID NO: 765 - RNA, 21 nt, Artificial Sequence
  Description of Artificial Sequence: Synthetic oligonucleotide
  modified_base (20)..(21): 2'-methoxy-nucleotide
guucuccuuuuccucucucuu

SEQ ID NO: 766 - RNA, 21 nt, Artificial Sequence
  Description of Artificial Sequence: Synthetic oligonucleotide
  modified_base (20)..(21): 2'-methoxy-nucleotide
uucuccuuuuccucucuccuu

SEQ ID NO: 767 - RNA, 21 nt, Artificial Sequence
  Description of Artificial Sequence: Synthetic oligonucleotide
  modified_base (20)..(21): 2'-methoxy-nucleotide
ucuccuuuuccucucucccuu

SEQ ID NO: 768 - RNA, 21 nt, Artificial Sequence
  Description of Artificial Sequence: Synthetic oligonucleotide
  modified_base (20)..(21): 2'-methoxy-nucleotide
cuccuuuuccucucucccguu

SEQ ID NO: 769 - RNA, 21 nt, Artificial Sequence
  Description of Artificial Sequence: Synthetic oligonucleotide
  modified_base (20)..(21): 2'-methoxy-nucleotide
uccuuuuccucucucccgguu

SEQ ID NO: 770 - RNA, 21 nt, Artificial Sequence
  Description of Artificial Sequence: Synthetic oligonucleotide
  modified_base (20)..(21): 2'-methoxy-nucleotide
ccuuuuccucucucccggauu

SEQ ID NO: 771 - RNA, 21 nt, Artificial Sequence
  Description of Artificial Sequence: Synthetic oligonucleotide
  modified_base (20)..(21): 2'-methoxy-nucleotide
cuuuuccucucucccggaguu

SEQ ID NO: 772 - RNA, 21 nt, Artificial Sequence
  Description of Artificial Sequence: Synthetic oligonucleotide
  modified_base (20)..(21): 2'-methoxy-nucleotide
uuuuccucucucccggagguu

SEQ ID NO: 773 - RNA, 21 nt, Artificial Sequence
  Description of Artificial Sequence: Synthetic oligonucleotide
  modified_base (20)..(21): 2'-methoxy-nucleotide
uuuccucucucccggagguuu

SEQ ID NO: 774 - RNA, 21 nt, Artificial Sequence
  Description of Artificial Sequence: Synthetic oligonucleotide
  modified_base (20)..(21): 2'-methoxy-nucleotide
uuccucucucccggagguuuu

SEQ ID NO: 775 - RNA, 21 nt, Artificial Sequence
  Description of Artificial Sequence: Synthetic oligonucleotide
  modified_base (20)..(21): 2'-methoxy-nucleotide
uccucucucccggagguuguu

SEQ ID NO: 776 - RNA, 21 nt, Artificial Sequence
  Description of Artificial Sequence: Synthetic oligonucleotide
  modified_base (20)..(21): 2'-methoxy-nucleotide
ccucucucccggagguugguu

SEQ ID NO: 777 - RNA, 21 nt, Artificial Sequence
  Description of Artificial Sequence: Synthetic oligonucleotide
  modified_base (20)..(21): 2'-methoxy-nucleotide
cucucucccggagguuggguu

SEQ ID NO: 778 - RNA, 21 nt, Artificial Sequence
  Description of Artificial Sequence: Synthetic oligonucleotide
  modified_base (20)..(21): 2'-methoxy-nucleotide
ucucucccggagguuggguuu

SEQ ID NO: 779 - RNA, 21 nt, Artificial Sequence
  Description of Artificial Sequence: Synthetic oligonucleotide
  modified_base (20)..(21): 2'-methoxy-nucleotide
cucucccggagguuggguguu

SEQ ID NO: 780 - RNA, 21 nt, Artificial Sequence
  Description of Artificial Sequence: Synthetic oligonucleotide
  modified_base (20)..(21): 2'-methoxy-nucleotide
ucucccggagguugggugguu

SEQ ID NO: 781 - RNA, 21 nt, Artificial Sequence
  Description of Artificial Sequence: Synthetic oligonucleotide
  modified_base (20)..(21): 2'-methoxy-nucleotide
cucccggagguuggguggguu

SEQ ID NO: 782 - RNA, 21 nt, Artificial Sequence
  Description of Artificial Sequence: Synthetic oligonucleotide
  modified_base (20)..(21): 2'-methoxy-nucleotide
ucccggagguugggugggcuu

SEQ ID NO: 783 - RNA, 21 nt, Artificial Sequence
  Description of Artificial Sequence: Synthetic oligonucleotide
  modified_base (20)..(21): 2'-methoxy-nucleotide
cccggagguugggugggccuu

SEQ ID NO: 784 - RNA, 21 nt, Artificial Sequence
  Description of Artificial Sequence: Synthetic oligonucleotide
  modified_base (20)..(21): 2'-methoxy-nucleotide
ccggagguugggugggccguu

SEQ ID NO: 785 - RNA, 21 nt, Artificial Sequence
  Description of Artificial Sequence: Synthetic oligonucleotide
  modified_base (20)..(21): 2'-methoxy-nucleotide
cggagguugggugggccgguu

SEQ ID NO: 786 - RNA, 21 nt, Artificial Sequence
  Description of Artificial Sequence: Synthetic oligonucleotide
  modified_base (20)..(21): 2'-methoxy-nucleotide
ggagguugggugggccggcuu

SEQ ID NO: 787 - RNA, 21 nt, Artificial Sequence
  Description of Artificial Sequence: Synthetic oligonucleotide
  modified_base (20)..(21): 2'-methoxy-nucleotide
gagguugggugggccggcuuu

SEQ ID NO: 788 - RNA, 21 nt, Artificial Sequence
  Description of Artificial Sequence: Synthetic oligonucleotide
  modified_base (20)..(21): 2'-methoxy-nucleotide
agguugggugggccggcuuuu

SEQ ID NO: 789 - RNA, 21 nt, Artificial Sequence
  Description of Artificial Sequence: Synthetic oligonucleotide
  modified_base (20)..(21): 2'-methoxy-nucleotide
gguugggugggccggcuucuu

SEQ ID NO: 790 - RNA, 21 nt, Artificial Sequence
  Description of Artificial Sequence: Synthetic oligonucleotide
  modified_base (20)..(21): 2'-methoxy-nucleotide
guugggugggccggcuucauu

SEQ ID NO: 791 - RNA, 21 nt, Artificial Sequence
  Description of Artificial Sequence: Synthetic oligonucleotide
  modified_base (20)..(21): 2'-methoxy-nucleotide
uugggugggccggcuucauuu

SEQ ID NO: 792 - RNA, 21 nt, Artificial Sequence
  Description of Artificial Sequence: Synthetic oligonucleotide
  modified_base (20)..(21): 2'-methoxy-nucleotide
ugggugggccggcuucauguu

SEQ ID NO: 793 - RNA, 21 nt, Artificial Sequence
  Description of Artificial Sequence: Synthetic oligonucleotide
  modified_base (20)..(21): 2'-methoxy-nucleotide
gggugggccggcuucaugcuu

SEQ ID NO: 794 - RNA, 21 nt, Artificial Sequence
  Description of Artificial Sequence: Synthetic oligonucleotide
  modified_base (20)..(21): 2'-methoxy-nucleotide
ggugggccggcuucaugccuu

SEQ ID NO: 795 - RNA, 21 nt, Artificial Sequence
  Description of Artificial Sequence: Synthetic oligonucleotide
  modified_base (20)..(21): 2'-methoxy-nucleotide
gugggccggcuucaugccauu

SEQ ID NO: 796 - RNA, 21 nt, Artificial Sequence
  Description of Artificial Sequence: Synthetic oligonucleotide
  modified_base (20)..(21): 2'-methoxy-nucleotide
ugggccggcuucaugccaguu

SEQ ID NO: 797 - RNA, 21 nt, Artificial Sequence
  Description of Artificial Sequence: Synthetic oligonucleotide
  modified_base (20)..(21): 2'-methoxy-nucleotide
gggccggcuucaugccagcuu

SEQ ID NO: 798 - RNA, 21 nt, Artificial Sequence
  Description of Artificial Sequence: Synthetic oligonucleotide
  modified_base (20)..(21): 2'-methoxy-nucleotide
ggccggcuucaugccagcuuu

SEQ ID NO: 799 - RNA, 21 nt, Artificial Sequence
  Description of Artificial Sequence: Synthetic oligonucleotide
  modified_base (20)..(21): 2'-methoxy-nucleotide
gccggcuucaugccagcuauu

SEQ ID NO: 800 - RNA, 21 nt, Artificial Sequence
  Description of Artificial Sequence: Synthetic oligonucleotide
  modified_base (20)..(21): 2'-methoxy-nucleotide
ccggcuucaugccagcuacuu

SEQ ID NO: 801 - RNA, 21 nt, Artificial Sequence
  Description of Artificial Sequence: Synthetic oligonucleotide
  modified_base (20)..(21): 2'-methoxy-nucleotide
cggcuucaugccagcuacuuu

SEQ ID NO: 802 - RNA, 21 nt, Artificial Sequence
  Description of Artificial Sequence: Synthetic oligonucleotide
  modified_base (20)..(21): 2'-methoxy-nucleotide
ggcuucaugccagcuacuuuu

SEQ ID NO: 803 - RNA, 21 nt, Artificial Sequence
  Description of Artificial Sequence: Synthetic oligonucleotide
  modified_base (20)..(21): 2'-methoxy-nucleotide
gcuucaugccagcuacuucuu

SEQ ID NO: 804 - RNA, 21 nt, Artificial Sequence
  Description of Artificial Sequence: Synthetic oligonucleotide
  modified_base (20)..(21): 2'-methoxy-nucleotide
cuucaugccagcuacuuccuu

SEQ ID NO: 805 - RNA, 21 nt, Artificial Sequence
  Description of Artificial Sequence: Synthetic oligonucleotide
  modified_base (20)..(21): 2'-methoxy-nucleotide
uucaugccagcuacuuccuuu

SEQ ID NO: 806 - RNA, 21 nt, Artificial Sequence
  Description of Artificial Sequence: Synthetic oligonucleotide
  modified_base (20)..(21): 2'-methoxy-nucleotide
ucaugccagcuacuuccucuu

SEQ ID NO: 807 - RNA, 21 nt, Artificial Sequence
  Description of Artificial Sequence: Synthetic oligonucleotide
  modified_base (20)..(21): 2'-methoxy-nucleotide
caugccagcuacuuccuccuu

SEQ ID NO: 808 - RNA, 21 nt, Artificial Sequence
  Description of Artificial Sequence: Synthetic oligonucleotide
  modified_base (20)..(21): 2'-methoxy-nucleotide
augccagcuacuuccuccuuu

SEQ ID NO: 809 - RNA, 21 nt, Artificial Sequence
  Description of Artificial Sequence: Synthetic oligonucleotide
  modified_base (20)..(21): 2'-methoxy-nucleotide
ugccagcuacuuccuccucuu

SEQ ID NO: 810 - RNA, 21 nt, Artificial Sequence
  Description of Artificial Sequence: Synthetic oligonucleotide
  modified_base (20)..(21): 2'-methoxy-nucleotide
gccagcuacuuccuccuccuu

SEQ ID NO: 811 - RNA, 21 nt, Artificial Sequence
  Description of Artificial Sequence: Synthetic oligonucleotide
  modified_base (20)..(21): 2'-methoxy-nucleotide
ccagcuacuuccuccucccuu

SEQ ID NO: 812 - RNA, 21 nt, Artificial Sequence
  Description of Artificial Sequence: Synthetic oligonucleotide
  modified_base (20)..(21): 2'-methoxy-nucleotide
cagcuacuuccuccuccccuu

SEQ ID NO: 813 - RNA, 21 nt, Artificial Sequence
  Description of Artificial Sequence: Synthetic oligonucleotide
  modified_base (20)..(21): 2'-methoxy-nucleotide
agcuacuuccuccuccccauu

SEQ ID NO: 814 - RNA, 21 nt, Artificial Sequence
  Description of Artificial Sequence: Synthetic oligonucleotide
  modified_base (20)..(21): 2'-methoxy-nucleotide
gcuacuuccuccuccccacuu

SEQ ID NO: 815 - RNA, 21 nt, Artificial Sequence
  Description of Artificial Sequence: Synthetic oligonucleotide
  modified_base (20)..(21): 2'-methoxy-nucleotide
cuacuuccuccuccccacuuu

SEQ ID NO: 816 - RNA, 21 nt, Artificial Sequence
  Description of Artificial Sequence: Synthetic oligonucleotide
  modified_base (20)..(21): 2'-methoxy-nucleotide
uacuuccuccuccccacuuuu

SEQ ID NO: 817 - RNA, 21 nt, Artificial Sequence
  Description of Artificial Sequence: Synthetic oligonucleotide
  modified_base (20)..(21): 2'-methoxy-nucleotide
acuuccuccuccccacuuguu

SEQ ID NO: 818 - RNA, 21 nt, Artificial Sequence
  Description of Artificial Sequence: Synthetic oligonucleotide
  modified_base (20)..(21): 2'-methoxy-nucleotide
cuuccuccuccccacuuguuu

SEQ ID NO: 819 - RNA, 21 nt, Artificial Sequence
  Description of Artificial Sequence: Synthetic oligonucleotide
  modified_base (20)..(21): 2'-methoxy-nucleotide
uuccuccuccccacuugucuu

SEQ ID NO: 820 - RNA, 21 nt, Artificial Sequence
  Description of Artificial Sequence: Synthetic oligonucleotide
  modified_base (20)..(21): 2'-methoxy-nucleotide
uccuccuccccacuuguccuu

SEQ ID NO: 821 - RNA, 21 nt, Artificial Sequence
  Description of Artificial Sequence: Synthetic oligonucleotide
  modified_base (20)..(21): 2'-methoxy-nucleotide
ccuccuccccacuuguccguu

SEQ ID NO: 822 - RNA, 21 nt, Artificial Sequence
  Description of Artificial Sequence: Synthetic oligonucleotide
  modified_base (20)..(21): 2'-methoxy-nucleotide
cuccuccccacuuguccgcuu

SEQ ID NO: 823 - RNA, 21 nt, Artificial Sequence
  Description of Artificial Sequence: Synthetic oligonucleotide
  modified_base (20)..(21): 2'-methoxy-nucleotide
uccuccccacuuguccgcuuu

SEQ ID NO: 824 - RNA, 21 nt, Artificial Sequence
  Description of Artificial Sequence: Synthetic oligonucleotide
  modified_base (20)..(21): 2'-methoxy-nucleotide
ccuccccacuuguccgcuguu

SEQ ID NO: 825 - RNA, 21 nt, Artificial Sequence
  Description of Artificial Sequence: Synthetic oligonucleotide
  modified_base (20)..(21): 2'-methoxy-nucleotide
cuccccacuuguccgcugguu

SEQ ID NO: 826 - RNA, 21 nt, Artificial Sequence
  Description of Artificial Sequence: Synthetic oligonucleotide
  modified_base (20)..(21): 2'-methoxy-nucleotide
uccccacuuguccgcuggguu

SEQ ID NO: 827 - RNA, 21 nt, Artificial Sequence
  Description of Artificial Sequence: Synthetic oligonucleotide
  modified_base (20)..(21): 2'-methoxy-nucleotide
ccccacuuguccgcuggguuu

SEQ ID NO: 828 - RNA, 21 nt, Artificial Sequence
  Description of Artificial Sequence: Synthetic oligonucleotide
  modified_base (20)..(21): 2'-methoxy-nucleotide
cccacuuguccgcuggguguu

SEQ ID NO: 829 - RNA, 21 nt, Artificial Sequence
  Description of Artificial Sequence: Synthetic oligonucleotide
  modified_base (20)..(21): 2'-methoxy-nucleotide
ccacuuguccgcugggugguu

SEQ ID NO: 830 - RNA, 21 nt, Artificial Sequence
  Description of Artificial Sequence: Synthetic oligonucleotide
  modified_base (20)..(21): 2'-methoxy-nucleotide
cacuuguccgcugggugguuu

SEQ ID NO: 831 - RNA, 21 nt, Artificial Sequence
  Description of Artificial Sequence: Synthetic oligonucleotide
  modified_base (20)..(21): 2'-methoxy-nucleotide
acuuguccgcugggugguauu

SEQ ID NO: 832 - RNA, 21 nt, Artificial Sequence
  Description of Artificial Sequence: Synthetic oligonucleotide
  modified_base (20)..(21): 2'-methoxy-nucleotide
cuuguccgcugggugguacuu

SEQ ID NO: 833 - RNA, 21 nt, Artificial Sequence
  Description of Artificial Sequence: Synthetic oligonucleotide
  modified_base (20)..(21): 2'-methoxy-nucleotide
uuguccgcugggugguaccuu

SEQ ID NO: 834 - RNA, 21 nt, Artificial Sequence
  Description of Artificial Sequence: Synthetic oligonucleotide
  modified_base (20)..(21): 2'-methoxy-nucleotide
uguccgcugggugguacccuu

SEQ ID NO: 835 - RNA, 21 nt, Artificial Sequence
  Description of Artificial Sequence: Synthetic oligonucleotide
  modified_base (20)..(21): 2'-methoxy-nucleotide
guccgcugggugguacccuuu

SEQ ID NO: 836 - RNA, 21 nt, Artificial Sequence
  Description of Artificial Sequence: Synthetic oligonucleotide
  modified_base (20)..(21): 2'-methoxy-nucleotide
uccgcugggugguacccucuu

SEQ ID NO: 837 - RNA, 21 nt, Artificial Sequence
  Description of Artificial Sequence: Synthetic oligonucleotide
  modified_base (20)..(21): 2'-methoxy-nucleotide
ccgcugggugguacccucuuu

SEQ ID NO: 838 - RNA, 21 nt, Artificial Sequence
  Description of Artificial Sequence: Synthetic oligonucleotide
  modified_base (20)..(21): 2'-methoxy-nucleotide
cgcugggugguacccucuguu

SEQ ID NO: 839 - RNA, 21 nt, Artificial Sequence
  Description of Artificial Sequence: Synthetic oligonucleotide
  modified_base (20)..(21): 2'-methoxy-nucleotide
gcugggugguacccucugguu

SEQ ID NO: 840 - RNA, 21 nt, Artificial Sequence
  Description of Artificial Sequence: Synthetic oligonucleotide
  modified_base (20)..(21): 2'-methoxy-nucleotide
cugggugguacccucuggauu

SEQ ID NO: 841 - RNA, 21 nt, Artificial Sequence
  Description of Artificial Sequence: Synthetic oligonucleotide
  modified_base (20)..(21): 2'-methoxy-nucleotide
ugggugguacccucuggaguu

SEQ ID NO: 842 - RNA, 21 nt, Artificial Sequence
  Description of Artificial Sequence: Synthetic oligonucleotide
  modified_base (20)..(21): 2'-methoxy-nucleotide
gggugguacccucuggagguu

SEQ ID NO: 843 - RNA, 21 nt, Artificial Sequence
  Description of Artificial Sequence: Synthetic oligonucleotide
  modified_base (20)..(21): 2'-methoxy-nucleotide
ggugguacccucuggaggguu

SEQ ID NO: 844 - RNA, 21 nt, Artificial Sequence
  Description of Artificial Sequence: Synthetic oligonucleotide
  modified_base (20)..(21): 2'-methoxy-nucleotide
gugguacccucuggagggguu

SEQ ID NO: 845 - RNA, 21 nt, Artificial Sequence
  Description of Artificial Sequence: Synthetic oligonucleotide
  modified_base (20)..(21): 2'-methoxy-nucleotide
ugguacccucuggagggguuu

SEQ ID NO: 846 - RNA, 21 nt, Artificial Sequence
  Description of Artificial Sequence: Synthetic oligonucleotide
  modified_base (20)..(21): 2'-methoxy-nucleotide
gguacccucuggagggguguu

SEQ ID NO: 847 - RNA, 21 nt, Artificial Sequence
  Description of Artificial Sequence: Synthetic oligonucleotide
  modified_base (20)..(21): 2'-methoxy-nucleotide
guacccucuggagggguguuu

SEQ ID NO: 848 - RNA, 21 nt, Artificial Sequence
  Description of Artificial Sequence: Synthetic oligonucleotide
  modified_base (20)..(21): 2'-methoxy-nucleotide
uacccucuggagggguguguu

SEQ ID NO: 849 - RNA, 21 nt, Artificial Sequence
  Description of Artificial Sequence: Synthetic oligonucleotide
  modified_base (20)..(21): 2'-methoxy-nucleotide
acccucuggaggggugugguu

SEQ ID NO: 850 - RNA, 21 nt, Artificial Sequence
  Description of Artificial Sequence: Synthetic oligonucleotide
  modified_base (20)..(21): 2'-methoxy-nucleotide
cccucuggagggguguggcuu

SEQ ID NO: 851 - RNA, 21 nt, Artificial Sequence
  Description of Artificial Sequence: Synthetic oligonucleotide
  modified_base (20)..(21): 2'-methoxy-nucleotide
ccucuggagggguguggcuuu

SEQ ID NO: 852 - RNA, 21 nt, Artificial Sequence
  Description of Artificial Sequence: Synthetic oligonucleotide
  modified_base (20)..(21): 2'-methoxy-nucleotide
cucuggagggguguggcucuu

SEQ ID NO: 853 - RNA, 21 nt, Artificial Sequence
  Description of Artificial Sequence: Synthetic oligonucleotide
  modified_base (20)..(21): 2'-methoxy-nucleotide
ucuggagggguguggcuccuu

SEQ ID NO: 854 - RNA, 21 nt, Artificial Sequence
  Description of Artificial Sequence: Synthetic oligonucleotide
  modified_base (20)..(21): 2'-methoxy-nucleotide
cuggagggguguggcuccuuu

SEQ ID NO: 855 - RNA, 21 nt, Artificial Sequence
  Description of Artificial Sequence: Synthetic oligonucleotide
  modified_base (20)..(21): 2'-methoxy-nucleotide
uggagggguguggcuccuuuu

SEQ ID NO: 856 - RNA, 21 nt, Artificial Sequence
  Description of Artificial Sequence: Synthetic oligonucleotide
  modified_base (20)..(21): 2'-methoxy-nucleotide
ggagggguguggcuccuucuu

SEQ ID NO: 857 - RNA, 21 nt, Artificial Sequence
  Description of Artificial Sequence: Synthetic oligonucleotide
  modified_base (20)..(21): 2'-methoxy-nucleotide
gagggguguggcuccuuccuu

SEQ ID NO: 858 - RNA, 21 nt, Artificial Sequence
  Description of Artificial Sequence: Synthetic oligonucleotide
  modified_base (20)..(21): 2'-methoxy-nucleotide
agggguguggcuccuucccuu

SEQ ID NO: 859 - RNA, 21 nt, Artificial Sequence
  Description of Artificial Sequence: Synthetic oligonucleotide
  modified_base (20)..(21): 2'-methoxy-nucleotide
gggguguggcuccuucccauu

SEQ ID NO: 860 - RNA, 21 nt, Artificial Sequence
  Description of Artificial Sequence: Synthetic oligonucleotide
  modified_base (20)..(21): 2'-methoxy-nucleotide
ggguguggcuccuucccauuu

SEQ ID NO: 861 - RNA, 21 nt, Artificial Sequence
  Description of Artificial Sequence: Synthetic oligonucleotide
  modified_base (20)..(21): 2'-methoxy-nucleotide
gguguggcuccuucccaucuu

SEQ ID NO: 862 - RNA, 21 nt, Artificial Sequence
  Description of Artificial Sequence: Synthetic oligonucleotide
  modified_base (20)..(21): 2'-methoxy-nucleotide
guguggcuccuucccaucguu

SEQ ID NO: 863 - RNA, 21 nt, Artificial Sequence
  Description of Artificial Sequence: Synthetic oligonucleotide
  modified_base (20)..(21): 2'-methoxy-nucleotide
uguggcuccuucccaucgcuu

SEQ ID NO: 864 - RNA, 21 nt, Artificial Sequence
  Description of Artificial Sequence: Synthetic oligonucleotide
  modified_base (20)..(21): 2'-methoxy-nucleotide
guggcuccuucccaucgcuuu

SEQ ID NO: 865 - RNA, 21 nt, Artificial Sequence
  Description of Artificial Sequence: Synthetic oligonucleotide
  modified_base (20)..(21): 2'-methoxy-nucleotide
uggcuccuucccaucgcuguu

SEQ ID NO: 866 - RNA, 21 nt, Artificial Sequence
  Description of Artificial Sequence: Synthetic oligonucleotide
  modified_base (20)..(21): 2'-methoxy-nucleotide
ggcuccuucccaucgcuguuu

SEQ ID NO: 867 - RNA, 21 nt, Artificial Sequence
  Description of Artificial Sequence: Synthetic oligonucleotide
  modified_base (20)..(21): 2'-methoxy-nucleotide
gcuccuucccaucgcugucuu

SEQ ID NO: 868 - RNA, 21 nt, Artificial Sequence
  Description of Artificial Sequence: Synthetic oligonucleotide
  modified_base (20)..(21): 2'-methoxy-nucleotide
cuccuucccaucgcugucauu

SEQ ID NO: 869 - RNA, 21 nt, Artificial Sequence
  Description of Artificial Sequence: Synthetic oligonucleotide
  modified_base (20)..(21): 2'-methoxy-nucleotide
uccuucccaucgcugucacuu

SEQ ID NO: 870 - RNA, 21 nt, Artificial Sequence
  Description of Artificial Sequence: Synthetic oligonucleotide
  modified_base (20)..(21): 2'-methoxy-nucleotide
ccuucccaucgcugucacauu

SEQ ID NO: 871 - RNA, 21 nt, Artificial Sequence
  Description of Artificial Sequence: Synthetic oligonucleotide
  modified_base (20)..(21): 2'-methoxy-nucleotide
cuucccaucgcugucacaguu

SEQ ID NO: 872 - RNA, 21 nt, Artificial Sequence
  Description of Artificial Sequence: Synthetic oligonucleotide
  modified_base (20)..(21): 2'-methoxy-nucleotide
uucccaucgcugucacagguu

SEQ ID NO: 873 - RNA, 21 nt, Artificial Sequence
  Description of Artificial Sequence: Synthetic oligonucleotide
  modified_base (20)..(21): 2'-methoxy-nucleotide
ucccaucgcugucacaggcuu

SEQ ID NO: 874 - RNA, 21 nt, Artificial Sequence
  Description of Artificial Sequence: Synthetic oligonucleotide
  modified_base (20)..(21): 2'-methoxy-nucleotide
cccaucgcugucacaggcguu

SEQ ID NO: 875 - RNA, 21 nt, Artificial Sequence
  Description of Artificial Sequence: Synthetic oligonucleotide
  modified_base (20)..(21): 2'-methoxy-nucleotide
ccaucgcugucacaggcgguu

SEQ ID NO: 876 - RNA, 21 nt, Artificial Sequence
  Description of Artificial Sequence: Synthetic oligonucleotide
  modified_base (20)..(21): 2'-methoxy-nucleotide
caucgcugucacaggcgguuu

SEQ ID NO: 877 - RNA, 21 nt, Artificial Sequence
  Description of Artificial Sequence: Synthetic oligonucleotide
  modified_base (20)..(21): 2'-methoxy-nucleotide
aucgcugucacaggcgguuuu

SEQ ID NO: 878 - RNA, 21 nt, Artificial Sequence
  Description of Artificial Sequence: Synthetic oligonucleotide
  modified_base (20)..(21): 2'-methoxy-nucleotide
ucgcugucacaggcgguuauu

SEQ ID NO: 879 - RNA, 21 nt, Artificial Sequence
  Description of Artificial Sequence: Synthetic oligonucleotide
  modified_base (20)..(21): 2'-methoxy-nucleotide
cgcugucacaggcgguuauuu

SEQ ID NO: 880 - RNA, 21 nt, Artificial Sequence
  Description of Artificial Sequence: Synthetic oligonucleotide
  modified_base (20)..(21): 2'-methoxy-nucleotide
gcugucacaggcgguuauguu

SEQ ID NO: 881 - RNA, 21 nt, Artificial Sequence
  Description of Artificial Sequence: Synthetic oligonucleotide
  modified_base (20)..(21): 2'-methoxy-nucleotide
cugucacaggcgguuaugauu

SEQ ID NO: 882 - RNA, 21 nt, Artificial Sequence
  Description of Artificial Sequence: Synthetic oligonucleotide
  modified_base (20)..(21): 2'-methoxy-nucleotide
ugucacaggcgguuaugaauu

SEQ ID NO: 883 - RNA, 21 nt, Artificial Sequence
  Description of Artificial Sequence: Synthetic oligonucleotide
  modified_base (20)..(21): 2'-methoxy-nucleotide
gucacaggcgguuaugaaauu

SEQ ID NO: 884 - RNA, 21 nt, Artificial Sequence
  Description of Artificial Sequence: Synthetic oligonucleotide
  modified_base (20)..(21): 2'-methoxy-nucleotide
ucacaggcgguuaugaaauuu

SEQ ID NO: 885 - RNA, 21 nt, Artificial Sequence
  Description of Artificial Sequence: Synthetic oligonucleotide
  modified_base (20)..(21): 2'-methoxy-nucleotide
cacaggcgguuaugaaauuuu

SEQ ID NO: 886 - RNA, 21 nt, Artificial Sequence
  Description of Artificial Sequence: Synthetic oligonucleotide
  modified_base (20)..(21): 2'-methoxy-nucleotide
acaggcgguuaugaaauucuu

SEQ ID NO: 887 - RNA, 21 nt, Artificial Sequence
  Description of Artificial Sequence: Synthetic oligonucleotide
  modified_base (20)..(21): 2'-methoxy-nucleotide
caggcgguuaugaaauucauu

SEQ ID NO: 888 - RNA, 21 nt, Artificial Sequence
  Description of Artificial Sequence: Synthetic oligonucleotide
  modified_base (20)..(21): 2'-methoxy-nucleotide
aggcgguuaugaaauucacuu

SEQ ID NO: 889 - RNA, 21 nt, Artificial Sequence
  Description of Artificial Sequence: Synthetic oligonucleotide
  modified_base (20)..(21): 2'-methoxy-nucleotide
ggcgguuaugaaauucaccuu

SEQ ID NO: 890 - RNA, 21 nt, Artificial Sequence
  Description of Artificial Sequence: Synthetic oligonucleotide
  modified_base (20)..(21): 2'-methoxy-nucleotide
gcgguuaugaaauucacccuu

SEQ ID NO: 891 - RNA, 21 nt, Artificial Sequence
  Description of Artificial Sequence: Synthetic oligonucleotide
  modified_base (20)..(21): 2'-methoxy-nucleotide
cgguuaugaaauucaccccuu

SEQ ID NO: 892 - RNA, 21 nt, Artificial Sequence
  Description of Artificial Sequence: Synthetic oligonucleotide
  modified_base (20)..(21): 2'-methoxy-nucleotide
gguuaugaaauucacccccuu

SEQ ID NO: 893 - RNA, 21 nt, Artificial Sequence
  Description of Artificial Sequence: Synthetic oligonucleotide
  modified_base (20)..(21): 2'-methoxy-nucleotide
guuaugaaauucacccccuuu

SEQ ID NO: 894 - RNA, 21 nt, Artificial Sequence
  Description of Artificial Sequence: Synthetic oligonucleotide
  modified_base (20)..(21): 2'-methoxy-nucleotide
uuaugaaauucacccccuuuu

SEQ ID NO: 895 - RNA, 21 nt, Artificial Sequence
  Description of Artificial Sequence: Synthetic oligonucleotide
  modified_base (20)..(21): 2'-methoxy-nucleotide
uaugaaauucacccccuuuuu

SEQ ID NO: 896 - RNA, 21 nt, Artificial Sequence
  Description of Artificial Sequence: Synthetic oligonucleotide
  modified_base (20)..(21): 2'-methoxy-nucleotide
augaaauucacccccuuucuu

SEQ ID NO: 897 - RNA, 21 nt, Artificial Sequence
  Description of Artificial Sequence: Synthetic oligonucleotide
  modified_base (20)..(21): 2'-methoxy-nucleotide
ugaaauucacccccuuuccuu

SEQ ID NO: 898 - RNA, 21 nt, Artificial Sequence
  Description of Artificial Sequence: Synthetic oligonucleotide
  modified_base (20)..(21): 2'-methoxy-nucleotide
gaaauucacccccuuuccuuu

SEQ ID NO: 899 - RNA, 21 nt, Artificial Sequence
  Description of Artificial Sequence: Synthetic oligonucleotide
  modified_base (20)..(21): 2'-methoxy-nucleotide
aaauucacccccuuuccuguu

SEQ ID NO: 900 - RNA, 21 nt, Artificial Sequence
  Description of Artificial Sequence: Synthetic oligonucleotide
  modified_base (20)..(21): 2'-methoxy-nucleotide
aauucacccccuuuccugguu

SEQ ID NO: 901 - RNA, 21 nt, Artificial Sequence
  Description of Artificial Sequence: Synthetic oligonucleotide
  modified_base (20)..(21): 2'-methoxy-nucleotide
auucacccccuuuccuggauu

SEQ ID NO: 902 - RNA, 21 nt, Artificial Sequence
  Description of Artificial Sequence: Synthetic oligonucleotide
  modified_base (20)..(21): 2'-methoxy-nucleotide
uucacccccuuuccuggacuu

SEQ ID NO: 903 - RNA, 21 nt, Artificial Sequence
  Description of Artificial Sequence: Synthetic oligonucleotide
  modified_base (20)..(21): 2'-methoxy-nucleotide
ucacccccuuuccuggacauu

SEQ ID NO: 904 - RNA, 21 nt, Artificial Sequence
  Description of Artificial Sequence: Synthetic oligonucleotide
  modified_base (20)..(21): 2'-methoxy-nucleotide
cacccccuuuccuggacacuu

SEQ ID NO: 905 - RNA, 21 nt, Artificial Sequence
  Description of Artificial Sequence: Synthetic oligonucleotide
  modified_base (20)..(21): 2'-methoxy-nucleotide
acccccuuuccuggacacuuu

SEQ ID NO: 906 - RNA, 21 nt, Artificial Sequence
  Description of Artificial Sequence: Synthetic oligonucleotide
  modified_base (20)..(21): 2'-methoxy-nucleotide
cccccuuuccuggacacucuu

SEQ ID NO: 907 - RNA, 21 nt, Artificial Sequence
  Description of Artificial Sequence: Synthetic oligonucleotide
  modified_base (20)..(21): 2'-methoxy-nucleotide
ccccuuuccuggacacucauu

SEQ ID NO: 908 - RNA, 21 nt, Artificial Sequence
  Description of Artificial Sequence: Synthetic oligonucleotide
  modified_base (20)..(21): 2'-methoxy-nucleotide
cccuuuccuggacacucaguu

SEQ ID NO: 909 - RNA, 21 nt, Artificial Sequence
  Description of Artificial Sequence: Synthetic oligonucleotide
  modified_base (20)..(21): 2'-methoxy-nucleotide
ccuuuccuggacacucagauu

SEQ ID NO: 910 - RNA, 21 nt, Artificial Sequence
  Description of Artificial Sequence: Synthetic oligonucleotide
  modified_base (20)..(21): 2'-methoxy-nucleotide
cuuuccuggacacucagacuu

SEQ ID NO: 911 - RNA, 21 nt, Artificial Sequence
  Description of Artificial Sequence: Synthetic oligonucleotide
  modified_base (20)..(21): 2'-methoxy-nucleotide
uuuccuggacacucagaccuu

SEQ ID NO: 912 - RNA, 21 nt, Artificial Sequence
  Description of Artificial Sequence: Synthetic oligonucleotide
  modified_base (20)..(21): 2'-methoxy-nucleotide
uuccuggacacucagaccuuu

SEQ ID NO: 913 - RNA, 21 nt, Artificial Sequence
  Description of Artificial Sequence: Synthetic oligonucleotide
  modified_base (20)..(21): 2'-methoxy-nucleotide
uccuggacacucagaccuguu

SEQ ID NO: 914 - RNA, 21 nt, Artificial Sequence
  Description of Artificial Sequence: Synthetic oligonucleotide
  modified_base (20)..(21): 2'-methoxy-nucleotide
ccuggacacucagaccugauu

SEQ ID NO: 915 - RNA, 21 nt, Artificial Sequence
  Description of Artificial Sequence: Synthetic oligonucleotide
  modified_base (20)..(21): 2'-methoxy-nucleotide
cuggacacucagaccugaauu

SEQ ID NO: 916 - RNA, 21 nt, Artificial Sequence
  Description of Artificial Sequence: Synthetic oligonucleotide
  modified_base (20)..(21): 2'-methoxy-nucleotide
uggacacucagaccugaauuu

SEQ ID NO: 917 - RNA, 21 nt, Artificial Sequence
  Description of Artificial Sequence: Synthetic oligonucleotide
  modified_base (20)..(21): 2'-methoxy-nucleotide
ggacacucagaccugaauuuu

SEQ ID NO: 918 - RNA, 21 nt, Artificial Sequence
  Description of Artificial Sequence: Synthetic oligonucleotide
  modified_base (20)..(21): 2'-methoxy-nucleotide
gacacucagaccugaauucuu

SEQ ID NO: 919 - RNA, 21 nt, Artificial Sequence
  Description of Artificial Sequence: Synthetic oligonucleotide
  modified_base (20)..(21): 2'-methoxy-nucleotide
acacucagaccugaauucuuu

SEQ ID NO: 920 - RNA, 21 nt, Artificial Sequence
  Description of Artificial Sequence: Synthetic oligonucleotide
  modified_base (20)..(21): 2'-methoxy-nucleotide
cacucagaccugaauucuuuu

SEQ ID NO: 921 - RNA, 21 nt, Artificial Sequence
  Description of Artificial Sequence: Synthetic oligonucleotide
  modified_base (20)..(21): 2'-methoxy-nucleotide
acucagaccugaauucuuuuu

SEQ ID NO: 922 - RNA, 21 nt, Artificial Sequence
  Description of Artificial Sequence: Synthetic oligonucleotide
  modified_base (20)..(21): 2'-methoxy-nucleotide
cucagaccugaauucuuuuuu

SEQ ID NO: 923 - RNA, 21 nt, Artificial Sequence
  Description of Artificial Sequence: Synthetic oligonucleotide
  modified_base (20)..(21): 2'-methoxy-nucleotide
ucagaccugaauucuuuuuuu

SEQ ID NO: 924 - RNA, 21 nt, Artificial Sequence
  Description of Artificial Sequence: Synthetic oligonucleotide
  modified_base (20)..(21): 2'-methoxy-nucleotide
cagaccugaauucuuuuucuu

SEQ ID NO: 925 - RNA, 21 nt, Artificial Sequence
  Description of Artificial Sequence: Synthetic oligonucleotide
  modified_base (20)..(21): 2'-methoxy-nucleotide
agaccugaauucuuuuucauu

SEQ ID NO: 926 - RNA, 21 nt, Artificial Sequence
  Description of Artificial Sequence: Synthetic oligonucleotide
  modified_base (20)..(21): 2'-methoxy-nucleotide
gaccugaauucuuuuucauuu

SEQ ID NO: 927 - RNA, 21 nt, Artificial Sequence
  Description of Artificial Sequence: Synthetic oligonucleotide
  modified_base (20)..(21): 2'-methoxy-nucleotide
accugaauucuuuuucauuuu

SEQ ID NO: 928 - RNA, 21 nt, Artificial Sequence
  Description of Artificial Sequence: Synthetic oligonucleotide
  modified_base (20)..(21): 2'-methoxy-nucleotide
ccugaauucuuuuucauuuuu

SEQ ID NO: 929 - RNA, 21 nt, Artificial Sequence
  Description of Artificial Sequence: Synthetic oligonucleotide
  modified_base (20)..(21): 2'-methoxy-nucleotide
cugaauucuuuuucauuuguu

SEQ ID NO: 930 - RNA, 21 nt, Artificial Sequence
  Description of Artificial Sequence: Synthetic oligonucleotide
  modified_base (20)..(21): 2'-methoxy-nucleotide
ugaauucuuuuucauuugauu

SEQ ID NO: 931 - RNA, 21 nt, Artificial Sequence
  Description of Artificial Sequence: Synthetic oligonucleotide
  modified_base (20)..(21): 2'-methoxy-nucleotide
gaauucuuuuucauuugaguu

SEQ ID NO: 932 - RNA, 21 nt, Artificial Sequence
  Description of Artificial Sequence: Synthetic oligonucleotide
  modified_base (20)..(21): 2'-methoxy-nucleotide
aauucuuuuucauuugagauu

SEQ ID NO: 933 - RNA, 21 nt, Artificial Sequence
  Description of Artificial Sequence: Synthetic oligonucleotide
  modified_base (20)..(21): 2'-methoxy-nucleotide
auucuuuuucauuugagaauu

SEQ ID NO: 934 - RNA, 21 nt, Artificial Sequence
  Description of Artificial Sequence: Synthetic oligonucleotide
  modified_base (20)..(21): 2'-methoxy-nucleotide
uucuuuuucauuugagaaguu

SEQ ID NO: 935 - RNA, 21 nt, Artificial Sequence
  Description of Artificial Sequence: Synthetic oligonucleotide
  modified_base (20)..(21): 2'-methoxy-nucleotide
ucuuuuucauuugagaaguuu

SEQ ID NO: 936 - RNA, 21 nt, Artificial Sequence
  Description of Artificial Sequence: Synthetic oligonucleotide
  modified_base (20)..(21): 2'-methoxy-nucleotide
cuuuuucauuugagaaguauu

SEQ ID NO: 937 - RNA, 21 nt, Artificial Sequence
  Description of Artificial Sequence: Synthetic oligonucleotide
  modified_base (20)..(21): 2'-methoxy-nucleotide
uuuuucauuugagaaguaauu

SEQ ID NO: 938 - RNA, 21 nt, Artificial Sequence
  Description of Artificial Sequence: Synthetic oligonucleotide
  modified_base (20)..(21): 2'-methoxy-nucleotide
uuuucauuugagaaguaaauu

SEQ ID NO: 939 - RNA, 21 nt, Artificial Sequence
  Description of Artificial Sequence: Synthetic oligonucleotide
  modified_base (20)..(21): 2'-methoxy-nucleotide
uuucauuugagaaguaaacuu

SEQ ID NO: 940 - RNA, 21 nt, Artificial Sequence
  Description of Artificial Sequence: Synthetic oligonucleotide
  modified_base (20)..(21): 2'-methoxy-nucleotide
uucauuugagaaguaaacauu

SEQ ID NO: 941 - RNA, 21 nt, Artificial Sequence
  Description of Artificial Sequence: Synthetic oligonucleotide
  modified_base (20)..(21): 2'-methoxy-nucleotide
ucauuugagaaguaaacaguu

SEQ ID NO: 942 - RNA, 21 nt, Artificial Sequence
  Description of Artificial Sequence: Synthetic oligonucleotide
  modified_base (20)..(21): 2'-methoxy-nucleotide
cauuugagaaguaaacagauu

SEQ ID NO: 943 - RNA, 21 nt, Artificial Sequence
  Description of Artificial Sequence: Synthetic oligonucleotide
  modified_base (20)..(21): 2'-methoxy-nucleotide
auuugagaaguaaacagauuu

SEQ ID NO: 944 - RNA, 21 nt, Artificial Sequence
  Description of Artificial Sequence: Synthetic oligonucleotide
  modified_base (20)..(21): 2'-methoxy-nucleotide
uuugagaaguaaacagauguu

SEQ ID NO: 945 - RNA, 21 nt, Artificial Sequence
  Description of Artificial Sequence: Synthetic oligonucleotide
  modified_base (20)..(21): 2'-methoxy-nucleotide
uugagaaguaaacagaugguu

SEQ ID NO: 946 - RNA, 21 nt, Artificial Sequence
  Description of Artificial Sequence: Synthetic oligonucleotide
  modified_base (20)..(21): 2'-methoxy-nucleotide
ugagaaguaaacagauggcuu

SEQ ID NO: 947 - RNA, 21 nt, Artificial Sequence
  Description of Artificial Sequence: Synthetic oligonucleotide
  modified_base (20)..(21): 2'-methoxy-nucleotide
gagaaguaaacagauggcauu

SEQ ID NO: 948 - RNA, 21 nt, Artificial Sequence
  Description of Artificial Sequence: Synthetic oligonucleotide
  modified_base (20)..(21): 2'-methoxy-nucleotide
agaaguaaacagauggcacuu

SEQ ID NO: 949 - RNA, 21 nt, Artificial Sequence
  Description of Artificial Sequence: Synthetic oligonucleotide
  modified_base (20)..(21): 2'-methoxy-nucleotide
gaaguaaacagauggcacuuu

SEQ ID NO: 950 - RNA, 21 nt, Artificial Sequence
  Description of Artificial Sequence: Synthetic oligonucleotide
  modified_base (20)..(21): 2'-methoxy-nucleotide
aaguaaacagauggcacuuuu

SEQ ID NO: 951 - RNA, 21 nt, Artificial Sequence
  Description of Artificial Sequence: Synthetic oligonucleotide
  modified_base (20)..(21): 2'-methoxy-nucleotide
aguaaacagauggcacuuuuu

SEQ ID NO: 952 - RNA, 21 nt, Artificial Sequence
  Description of Artificial Sequence: Synthetic oligonucleotide
  modified_base (20)..(21): 2'-methoxy-nucleotide
guaaacagauggcacuuuguu

SEQ ID NO: 953 - RNA, 21 nt, Artificial Sequence
  Description of Artificial Sequence: Synthetic oligonucleotide
  modified_base (20)..(21): 2'-methoxy-nucleotide
uaaacagauggcacuuugauu

SEQ ID NO: 954 - RNA, 21 nt, Artificial Sequence
  Description of Artificial Sequence: Synthetic oligonucleotide
  modified_base (20)..(21): 2'-methoxy-nucleotide
aaacagauggcacuuugaauu

SEQ ID NO: 955 - RNA, 21 nt, Artificial Sequence
  Description of Artificial Sequence: Synthetic oligonucleotide
  modified_base (20)..(21): 2'-methoxy-nucleotide
aacagauggcacuuugaaguu

SEQ ID NO: 956 - RNA, 21 nt, Artificial Sequence
  Description of Artificial Sequence: Synthetic oligonucleotide
  modified_base (20)..(21): 2'-methoxy-nucleotide
acagauggcacuuugaagguu

SEQ ID NO: 957 - RNA, 21 nt, Artificial Sequence
  Description of Artificial Sequence: Synthetic oligonucleotide
  modified_base (20)..(21): 2'-methoxy-nucleotide
cagauggcacuuugaaggguu

SEQ ID NO: 958 - RNA, 21 nt, Artificial Sequence
  Description of Artificial Sequence: Synthetic oligonucleotide
  modified_base (20)..(21): 2'-methoxy-nucleotide
agauggcacuuugaagggguu

SEQ ID NO: 959 - RNA, 21 nt, Artificial Sequence
  Description of Artificial Sequence: Synthetic oligonucleotide
  modified_base (20)..(21): 2'-methoxy-nucleotide
gauggcacuuugaaggggcuu

SEQ ID NO: 960 - RNA, 21 nt, Artificial Sequence
  Description of Artificial Sequence: Synthetic oligonucleotide
  modified_base (20)..(21): 2'-methoxy-nucleotide
auggcacuuugaaggggccuu

SEQ ID NO: 961 - RNA, 21 nt, Artificial Sequence
  Description of Artificial Sequence: Synthetic oligonucleotide
  modified_base (20)..(21): 2'-methoxy-nucleotide
uggcacuuugaaggggccuuu

SEQ ID NO: 962 - RNA, 21 nt, Artificial Sequence
  Description of Artificial Sequence: Synthetic oligonucleotide
  modified_base (20)..(21): 2'-methoxy-nucleotide
ggcacuuugaaggggccucuu

SEQ ID NO: 963 - RNA, 21 nt, Artificial Sequence
  Description of Artificial Sequence: Synthetic oligonucleotide
  modified_base (20)..(21): 2'-methoxy-nucleotide
gcacuuugaaggggccucauu

SEQ ID NO: 964 - RNA, 21 nt, Artificial Sequence
  Description of Artificial Sequence: Synthetic oligonucleotide
  modified_base (20)..(21): 2'-methoxy-nucleotide
cacuuugaaggggccucacuu

SEQ ID NO: 965 - RNA, 21 nt, Artificial Sequence
  Description of Artificial Sequence: Synthetic oligonucleotide
  modified_base (20)..(21): 2'-methoxy-nucleotide
acuuugaaggggccucaccuu

SEQ ID NO: 966 - RNA, 21 nt, Artificial Sequence
  Description of Artificial Sequence: Synthetic oligonucleotide
  modified_base (20)..(21): 2'-methoxy-nucleotide
cuuugaaggggccucaccguu

SEQ ID NO: 967 - RNA, 21 nt, Artificial Sequence
  Description of Artificial Sequence: Synthetic oligonucleotide
  modified_base (20)..(21): 2'-methoxy-nucleotide
uuugaaggggccucaccgauu

SEQ ID NO: 968 - RNA, 21 nt, Artificial Sequence
  Description of Artificial Sequence: Synthetic oligonucleotide
  modified_base (20)..(21): 2'-methoxy-nucleotide
uugaaggggccucaccgaguu

SEQ ID NO: 969 - RNA, 21 nt, Artificial Sequence
  Description of Artificial Sequence: Synthetic oligonucleotide
  modified_base (20)..(21): 2'-methoxy-nucleotide
ugaaggggccucaccgaguuu

SEQ ID NO: 970 - RNA, 21 nt, Artificial Sequence
  Description of Artificial Sequence: Synthetic oligonucleotide
  modified_base (20)..(21): 2'-methoxy-nucleotide
gaaggggccucaccgaguguu

SEQ ID NO: 971 - RNA, 21 nt, Artificial Sequence
  Description of Artificial Sequence: Synthetic oligonucleotide
  modified_base (20)..(21): 2'-methoxy-nucleotide
aaggggccucaccgagugguu

SEQ ID NO: 972 - RNA, 21 nt, Artificial Sequence
  Description of Artificial Sequence: Synthetic oligonucleotide
  modified_base (20)..(21): 2'-methoxy-nucleotide
aggggccucaccgaguggguu

SEQ ID NO: 973 - RNA, 21 nt, Artificial Sequence
  Description of Artificial Sequence: Synthetic oligonucleotide
  modified_base (20)..(21): 2'-methoxy-nucleotide
ggggccucaccgagugggguu

SEQ ID NO: 974 - RNA, 21 nt, Artificial Sequence
  Description of Artificial Sequence: Synthetic oligonucleotide
  modified_base (20)..(21): 2'-methoxy-nucleotide
gggccucaccgaguggggguu

SEQ ID NO: 975 - RNA, 21 nt, Artificial Sequence
  Description of Artificial Sequence: Synthetic oligonucleotide
  modified_base (20)..(21): 2'-methoxy-nucleotide
ggccucaccgagugggggcuu

SEQ ID NO: 976 - RNA, 21 nt, Artificial Sequence
  Description of Artificial Sequence: Synthetic oligonucleotide
  modified_base (20)..(21): 2'-methoxy-nucleotide
gccucaccgagugggggcauu

SEQ ID NO: 977 - RNA, 21 nt, Artificial Sequence
  Description of Artificial Sequence: Synthetic oligonucleotide
  modified_base (20)..(21): 2'-methoxy-nucleotide
ccucaccgagugggggcauuu

SEQ ID NO: 978 - RNA, 21 nt, Artificial Sequence
  Description of Artificial Sequence: Synthetic oligonucleotide
  modified_base (20)..(21): 2'-methoxy-nucleotide
cucaccgagugggggcaucuu

SEQ ID NO: 979 - RNA, 21 nt, Artificial Sequence
  Description of Artificial Sequence: Synthetic oligonucleotide
  modified_base (20)..(21): 2'-methoxy-nucleotide
ucaccgagugggggcaucauu

SEQ ID NO: 980 - RNA, 21 nt, Artificial Sequence
  Description of Artificial Sequence: Synthetic oligonucleotide
  modified_base (20)..(21): 2'-methoxy-nucleotide
caccgagugggggcaucauuu

SEQ ID NO: 981 - RNA, 21 nt, Artificial Sequence
  Description of Artificial Sequence: Synthetic oligonucleotide
  modified_base (20)..(21): 2'-methoxy-nucleotide
accgagugggggcaucaucuu

SEQ ID NO: 982 - RNA, 21 nt, Artificial Sequence
  Description of Artificial Sequence: Synthetic oligonucleotide
  modified_base (20)..(21): 2'-methoxy-nucleotide
ccgagugggggcaucaucauu

SEQ ID NO: 983 - RNA, 21 nt, Artificial Sequence
  Description of Artificial Sequence: Synthetic oligonucleotide
  modified_base (20)..(21): 2'-methoxy-nucleotide
cgagugggggcaucaucaauu

SEQ ID NO: 984 - RNA, 21 nt, Artificial Sequence
  Description of Artificial Sequence: Synthetic oligonucleotide
  modified_base (20)..(21): 2'-methoxy-nucleotide
gagugggggcaucaucaaauu

SEQ ID NO: 985 - RNA, 21 nt, Artificial Sequence
  Description of Artificial Sequence: Synthetic oligonucleotide
  modified_base (20)..(21): 2'-methoxy-nucleotide
agugggggcaucaucaaaauu

SEQ ID NO: 986 - RNA, 21 nt, Artificial Sequence
  Description of Artificial Sequence: Synthetic oligonucleotide
  modified_base (20)..(21): 2'-methoxy-nucleotide
gugggggcaucaucaaaaauu

SEQ ID NO: 987 - RNA, 21 nt, Artificial Sequence
  Description of Artificial Sequence: Synthetic oligonucleotide
  modified_base (20)..(21): 2'-methoxy-nucleotide
ugggggcaucaucaaaaacuu

SEQ ID NO: 988 - RNA, 21 nt, Artificial Sequence
  Description of Artificial Sequence: Synthetic oligonucleotide
  modified_base (20)..(21): 2'-methoxy-nucleotide
gggggcaucaucaaaaacuuu

SEQ ID NO: 989 - RNA, 21 nt, Artificial Sequence
  Description of Artificial Sequence: Synthetic oligonucleotide
  modified_base (20)..(21): 2'-methoxy-nucleotide
ggggcaucaucaaaaacuuuu

SEQ ID NO: 990 - RNA, 21 nt, Artificial Sequence
  Description of Artificial Sequence: Synthetic oligonucleotide
  modified_base (20)..(21): 2'-methoxy-nucleotide
gggcaucaucaaaaacuuuuu

SEQ ID NO: 991 - RNA, 21 nt, Artificial Sequence
  Description of Artificial Sequence: Synthetic oligonucleotide
  modified_base (20)..(21): 2'-methoxy-nucleotide
ggcaucaucaaaaacuuuguu

SEQ ID NO: 992 - RNA, 21 nt, Artificial Sequence
  Description of Artificial Sequence: Synthetic oligonucleotide
  modified_base (20)..(21): 2'-methoxy-nucleotide
gcaucaucaaaaacuuugguu

SEQ ID NO: 993 - RNA, 21 nt, Artificial Sequence
  Description of Artificial Sequence: Synthetic oligonucleotide
  modified_base (20)..(21): 2'-methoxy-nucleotide
caucaucaaaaacuuuggauu

SEQ ID NO: 994 - RNA, 21 nt, Artificial Sequence
  Description of Artificial Sequence: Synthetic oligonucleotide
  modified_base (20)..(21): 2'-methoxy-nucleotide
aucaucaaaaacuuuggaguu

SEQ ID NO: 995 - RNA, 21 nt, Artificial Sequence
  Description of Artificial Sequence: Synthetic oligonucleotide
  modified_base (20)..(21): 2'-methoxy-nucleotide
ucaucaaaaacuuuggaguuu

SEQ ID NO: 996 - RNA, 21 nt, Artificial Sequence
  Description of Artificial Sequence: Synthetic oligonucleotide
  modified_base (20)..(21): 2'-methoxy-nucleotide
caucaaaaacuuuggagucuu

SEQ ID NO: 997 - RNA, 21 nt, Artificial Sequence
  Description of Artificial Sequence: Synthetic oligonucleotide
  modified_base (20)..(21): 2'-methoxy-nucleotide
aucaaaaacuuuggaguccuu

SEQ ID NO: 998 - RNA, 21 nt, Artificial Sequence
  Description of Artificial Sequence: Synthetic oligonucleotide
  modified_base (20)..(21): 2'-methoxy-nucleotide
ucaaaaacuuuggagucccuu

SEQ ID NO: 999 - RNA, 21 nt, Artificial Sequence
  Description of Artificial Sequence: Synthetic oligonucleotide
  modified_base (20)..(21): 2'-methoxy-nucleotide
caaaaacuuuggaguccccuu

SEQ ID NO: 1000 - RNA, 21 nt, Artificial Sequence
  Description of Artificial Sequence: Synthetic oligonucleotide
  modified_base (20)..(21): 2'-methoxy-nucleotide
aaaaacuuuggaguccccuuu

SEQ ID NO: 1001 - RNA, 21 nt, Artificial Sequence
  Description of Artificial Sequence: Synthetic oligonucleotide
  modified_base (20)..(21): 2'-methoxy-nucleotide
aaaacuuuggaguccccucuu

SEQ ID NO: 1002 - RNA, 21 nt, Artificial Sequence
  Description of Artificial Sequence: Synthetic oligonucleotide
  modified_base (20)..(21): 2'-methoxy-nucleotide
aaacuuuggaguccccucauu

SEQ ID NO: 1003 - RNA, 21 nt, Artificial Sequence
  Description of Artificial Sequence: Synthetic oligonucleotide
  modified_base (20)..(21): 2'-methoxy-nucleotide
aacuuuggaguccccucacuu

SEQ ID NO: 1004 - RNA, 21 nt, Artificial Sequence
  Description of Artificial Sequence: Synthetic oligonucleotide
  modified_base (20)..(21): 2'-methoxy-nucleotide
acuuuggaguccccucaccuu

SEQ ID NO: 1005 - RNA, 21 nt, Artificial Sequence
  Description of Artificial Sequence: Synthetic oligonucleotide
  modified_base (20)..(21): 2'-methoxy-nucleotide
cuuuggaguccccucaccuuu

SEQ ID NO: 1006 - RNA, 21 nt, Artificial Sequence
  Description of Artificial Sequence: Synthetic oligonucleotide
  modified_base (20)..(21): 2'-methoxy-nucleotide
uuuggaguccccucaccucuu

SEQ ID NO: 1007 - RNA, 21 nt, Artificial Sequence
  Description of Artificial Sequence: Synthetic oligonucleotide
  modified_base (20)..(21): 2'-methoxy-nucleotide
uuggaguccccucaccuccuu

SEQ ID NO: 1008 - RNA, 21 nt, Artificial Sequence
  Description of Artificial Sequence: Synthetic oligonucleotide
  modified_base (20)..(21): 2'-methoxy-nucleotide
uggaguccccucaccuccuuu

SEQ ID NO: 1009 - RNA, 21 nt, Artificial Sequence
  Description of Artificial Sequence: Synthetic oligonucleotide
  modified_base (20)..(21): 2'-methoxy-nucleotide
ggaguccccucaccuccucuu

SEQ ID NO: 1010 - RNA, 21 nt, Artificial Sequence
  Description of Artificial Sequence: Synthetic oligonucleotide
  modified_base (20)..(21): 2'-methoxy-nucleotide
gaguccccucaccuccucuuu

SEQ ID NO: 1011 - RNA, 21 nt, Artificial Sequence
  Description of Artificial Sequence: Synthetic oligonucleotide
  modified_base (20)..(21): 2'-methoxy-nucleotide
aguccccucaccuccucuauu

SEQ ID NO: 1012 - RNA, 21 nt, Artificial Sequence
  Description of Artificial Sequence: Synthetic oligonucleotide
  modified_base (20)..(21): 2'-methoxy-nucleotide
guccccucaccuccucuaauu

SEQ ID NO: 1013 - RNA, 21 nt, Artificial Sequence
  Description of Artificial Sequence: Synthetic oligonucleotide
  modified_base (20)..(21): 2'-methoxy-nucleotide
uccccucaccuccucuaaguu

SEQ ID NO: 1014 - RNA, 21 nt, Artificial Sequence
  Description of Artificial Sequence: Synthetic oligonucleotide
  modified_base (20)..(21): 2'-methoxy-nucleotide
ccccucaccuccucuaagguu

SEQ ID NO: 1015 - RNA, 21 nt, Artificial Sequence
  Description of Artificial Sequence: Synthetic oligonucleotide
  modified_base (20)..(21): 2'-methoxy-nucleotide
cccucaccuccucuaagguuu

SEQ ID NO: 1016 - RNA, 21 nt, Artificial Sequence
  Description of Artificial Sequence: Synthetic oligonucleotide
  modified_base (20)..(21): 2'-methoxy-nucleotide
ccucaccuccucuaagguuuu

SEQ ID NO: 1017 - RNA, 21 nt, Artificial Sequence
  Description of Artificial Sequence: Synthetic oligonucleotide
  modified_base (20)..(21): 2'-methoxy-nucleotide
cucaccuccucuaagguuguu

SEQ ID NO: 1018 - RNA, 21 nt, Artificial Sequence
  Description of Artificial Sequence: Synthetic oligonucleotide
  modified_base (20)..(21): 2'-methoxy-nucleotide
ucaccuccucuaagguugguu

SEQ ID NO: 1019 - RNA, 21 nt, Artificial Sequence
  Description of Artificial Sequence: Synthetic oligonucleotide
  modified_base (20)..(21): 2'-methoxy-nucleotide
caccuccucuaagguuggguu

SEQ ID NO: 1020 - RNA, 21 nt, Artificial Sequence
  Description of Artificial Sequence: Synthetic oligonucleotide
  modified_base (20)..(21): 2'-methoxy-nucleotide
accuccucuaagguugggcuu

SEQ ID NO: 1021 - RNA, 21 nt, Artificial Sequence
  Description of Artificial Sequence: Synthetic oligonucleotide
  modified_base (20)..(21): 2'-methoxy-nucleotide
ccuccucuaagguugggcauu

SEQ ID NO: 1022 - RNA, 21 nt, Artificial Sequence
  Description of Artificial Sequence: Synthetic oligonucleotide
  modified_base (20)..(21): 2'-methoxy-nucleotide
cuccucuaagguugggcaguu

SEQ ID NO: 1023 - RNA, 21 nt, Artificial Sequence
  Description of Artificial Sequence: Synthetic oligonucleotide
  modified_base (20)..(21): 2'-methoxy-nucleotide
uccucuaagguugggcagguu

SEQ ID NO: 1024 - RNA, 21 nt, Artificial Sequence
  Description of Artificial Sequence: Synthetic oligonucleotide
  modified_base (20)..(21): 2'-methoxy-nucleotide
ccucuaagguugggcaggguu

SEQ ID NO: 1025 - RNA, 21 nt, Artificial Sequence
  Description of Artificial Sequence: Synthetic oligonucleotide
  modified_base (20)..(21): 2'-methoxy-nucleotide
cucuaagguugggcaggguuu

SEQ ID NO: 1026 - RNA, 21 nt, Artificial Sequence
  Description of Artificial Sequence: Synthetic oligonucleotide
  modified_base (20)..(21): 2'-methoxy-nucleotide
ucuaagguugggcaggguguu

SEQ ID NO: 1027 - RNA, 21 nt, Artificial Sequence
  Description of Artificial Sequence: Synthetic oligonucleotide
  modified_base (20)..(21): 2'-methoxy-nucleotide
cuaagguugggcagggugauu

SEQ ID NO: 1028 - RNA, 21 nt, Artificial Sequence
  Description of Artificial Sequence: Synthetic oligonucleotide
  modified_base (20)..(21): 2'-methoxy-nucleotide
uaagguugggcagggugacuu

SEQ ID NO: 1029 - RNA, 21 nt, Artificial Sequence
  Description of Artificial Sequence: Synthetic oligonucleotide
  modified_base (20)..(21): 2'-methoxy-nucleotide
aagguugggcagggugaccuu

SEQ ID NO: 1030 - RNA, 21 nt, Artificial Sequence
  Description of Artificial Sequence: Synthetic oligonucleotide
  modified_base (20)..(21): 2'-methoxy-nucleotide
agguugggcagggugacccuu

SEQ ID NO: 1031 - RNA, 21 nt, Artificial Sequence
  Description of Artificial Sequence: Synthetic oligonucleotide
  modified_base (20)..(21): 2'-methoxy-nucleotide
gguugggcagggugacccuuu

SEQ ID NO: 1032 - RNA, 21 nt, Artificial Sequence
  Description of Artificial Sequence: Synthetic oligonucleotide
  modified_base (20)..(21): 2'-methoxy-nucleotide
guugggcagggugacccuguu

SEQ ID NO: 1033 - RNA, 21 nt, Artificial Sequence
  Description of Artificial Sequence: Synthetic oligonucleotide
  modified_base (20)..(21): 2'-methoxy-nucleotide
uugggcagggugacccugauu

SEQ ID NO: 1034 - RNA, 21 nt, Artificial Sequence
  Description of Artificial Sequence: Synthetic oligonucleotide
  modified_base (20)..(21): 2'-methoxy-nucleotide
ugggcagggugacccugaauu

SEQ ID NO: 1035 - RNA, 21 nt, Artificial Sequence
  Description of Artificial Sequence: Synthetic oligonucleotide
  modified_base (20)..(21): 2'-methoxy-nucleotide
gggcagggugacccugaaguu

SEQ ID NO: 1036 - RNA, 21 nt, Artificial Sequence
  Description of Artificial Sequence: Synthetic oligonucleotide
  modified_base (20)..(21): 2'-methoxy-nucleotide
ggcagggugacccugaaguuu

SEQ ID NO: 1037 - RNA, 21 nt, Artificial Sequence
  Description of Artificial Sequence: Synthetic oligonucleotide
  modified_base (20)..(21): 2'-methoxy-nucleotide
gcagggugacccugaaguguu

SEQ ID NO: 1038 - RNA, 21 nt, Artificial Sequence
  Description of Artificial Sequence: Synthetic oligonucleotide
  modified_base (20)..(21): 2'-methoxy-nucleotide
cagggugacccugaagugauu

SEQ ID NO: 1039 - RNA, 21 nt, Artificial Sequence
  Description of Artificial Sequence: Synthetic oligonucleotide
  modified_base (20)..(21): 2'-methoxy-nucleotide
agggugacccugaagugaguu

SEQ ID NO: 1040 - RNA, 21 nt, Artificial Sequence
  Description of Artificial Sequence: Synthetic oligonucleotide
  modified_base (20)..(21): 2'-methoxy-nucleotide
gggugacccugaagugagcuu

SEQ ID NO: 1041 - RNA, 21 nt, Artificial Sequence
  Description of Artificial Sequence: Synthetic oligonucleotide
  modified_base (20)..(21): 2'-methoxy-nucleotide
ggugacccugaagugagcauu

SEQ ID NO: 1042 - RNA, 21 nt, Artificial Sequence
  Description of Artificial Sequence: Synthetic oligonucleotide
  modified_base (20)..(21): 2'-methoxy-nucleotide
gugacccugaagugagcacuu

SEQ ID NO: 1043 - RNA, 21 nt, Artificial Sequence
  Description of Artificial Sequence: Synthetic oligonucleotide
  modified_base (20)..(21): 2'-methoxy-nucleotide
ugacccugaagugagcacauu

SEQ ID NO: 1044 - RNA, 21 nt, Artificial Sequence
  Description of Artificial Sequence: Synthetic oligonucleotide
  modified_base (20)..(21): 2'-methoxy-nucleotide
gacccugaagugagcacaguu

SEQ ID NO: 1045 - RNA, 21 nt, Artificial Sequence
  Description of Artificial Sequence: Synthetic oligonucleotide
  modified_base (20)..(21): 2'-methoxy-nucleotide
acccugaagugagcacagcuu

SEQ ID NO: 1046 - RNA, 21 nt, Artificial Sequence
  Description of Artificial Sequence: Synthetic oligonucleotide
  modified_base (20)..(21): 2'-methoxy-nucleotide
cccugaagugagcacagccuu

SEQ ID NO: 1047 - RNA, 21 nt, Artificial Sequence
  Description of Artificial Sequence: Synthetic oligonucleotide
  modified_base (20)..(21): 2'-methoxy-nucleotide
ccugaagugagcacagccuuu

SEQ ID NO: 1048 - RNA, 21 nt, Artificial Sequence
  Description of Artificial Sequence: Synthetic oligonucleotide
  modified_base (20)..(21): 2'-methoxy-nucleotide
cugaagugagcacagccuauu

SEQ ID NO: 1049 - RNA, 21 nt, Artificial Sequence
  Description of Artificial Sequence: Synthetic oligonucleotide
  modified_base (20)..(21): 2'-methoxy-nucleotide
ugaagugagcacagccuaguu

SEQ ID NO: 1050 - RNA, 21 nt, Artificial Sequence
  Description of Artificial Sequence: Synthetic oligonucleotide
  modified_base (20)..(21): 2'-methoxy-nucleotide
gaagugagcacagccuagguu

SEQ ID NO: 1051 - RNA, 21 nt, Artificial Sequence
  Description of Artificial Sequence: Synthetic oligonucleotide
  modified_base (20)..(21): 2'-methoxy-nucleotide
aagugagcacagccuaggguu

SEQ ID NO: 1052 - RNA, 21 nt, Artificial Sequence
  Description of Artificial Sequence: Synthetic oligonucleotide
  modified_base (20)..(21): 2'-methoxy-nucleotide
agugagcacagccuagggcuu

SEQ ID NO: 1053 - RNA, 21 nt, Artificial Sequence
  Description of Artificial Sequence: Synthetic oligonucleotide
  modified_base (20)..(21): 2'-methoxy-nucleotide
gugagcacagccuagggcuuu

SEQ ID NO: 1054 - RNA, 21 nt, Artificial Sequence
  Description of Artificial Sequence: Synthetic oligonucleotide
  modified_base (20)..(21): 2'-methoxy-nucleotide
ugagcacagccuagggcuguu

SEQ ID NO: 1055 - RNA, 21 nt, Artificial Sequence
  Description of Artificial Sequence: Synthetic oligonucleotide
  modified_base (20)..(21): 2'-methoxy-nucleotide
gagcacagccuagggcugauu

SEQ ID NO: 1056 - RNA, 21 nt, Artificial Sequence
  Description of Artificial Sequence: Synthetic oligonucleotide
  modified_base (20)..(21): 2'-methoxy-nucleotide
agcacagccuagggcugaguu

SEQ ID NO: 1057 - RNA, 21 nt, Artificial Sequence
  Description of Artificial Sequence: Synthetic oligonucleotide
  modified_base (20)..(21): 2'-methoxy-nucleotide
gcacagccuagggcugagcuu

SEQ ID NO: 1058 - RNA, 21 nt, Artificial Sequence
  Description of Artificial Sequence: Synthetic oligonucleotide
  modified_base (20)..(21): 2'-methoxy-nucleotide
cacagccuagggcugagcuuu

SEQ ID NO: 1059 - RNA, 21 nt, Artificial Sequence
  Description of Artificial Sequence: Synthetic oligonucleotide
  modified_base (20)..(21): 2'-methoxy-nucleotide
acagccuagggcugagcuguu

SEQ ID NO: 1060 - RNA, 21 nt, Artificial Sequence
  Description of Artificial Sequence: Synthetic oligonucleotide
  modified_base (20)..(21): 2'-methoxy-nucleotide
cagccuagggcugagcugguu

SEQ ID NO: 1061 - RNA, 21 nt, Artificial Sequence
  Description of Artificial Sequence: Synthetic oligonucleotide
  modified_base (20)..(21): 2'-methoxy-nucleotide
agccuagggcugagcuggguu

SEQ ID NO: 1062 - RNA, 21 nt, Artificial Sequence
  Description of Artificial Sequence: Synthetic oligonucleotide
  modified_base (20)..(21): 2'-methoxy-nucleotide
gccuagggcugagcugggguu

SEQ ID NO: 1063 - RNA, 21 nt, Artificial Sequence
  Description of Artificial Sequence: Synthetic oligonucleotide
  modified_base (20)..(21): 2'-methoxy-nucleotide
ccuagggcugagcuggggauu

SEQ ID NO: 1064 - RNA, 21 nt, Artificial Sequence
  Description of Artificial Sequence: Synthetic oligonucleotide
  modified_base (20)..(21): 2'-methoxy-nucleotide
cuagggcugagcuggggacuu

SEQ ID NO: 1065 - RNA, 21 nt, Artificial Sequence
  Description of Artificial Sequence: Synthetic oligonucleotide
  modified_base (20)..(21): 2'-methoxy-nucleotide
uagggcugagcuggggaccuu

SEQ ID NO: 1066 - RNA, 21 nt, Artificial Sequence
  Description of Artificial Sequence: Synthetic oligonucleotide
  modified_base (20)..(21): 2'-methoxy-nucleotide
agggcugagcuggggaccuuu

SEQ ID NO: 1067 - RNA, 21 nt, Artificial Sequence
  Description of Artificial Sequence: Synthetic oligonucleotide
  modified_base (20)..(21): 2'-methoxy-nucleotide
gggcugagcuggggaccuguu

SEQ ID NO: 1068 - RNA, 21 nt, Artificial Sequence
  Description of Artificial Sequence: Synthetic oligonucleotide
  modified_base (20)..(21): 2'-methoxy-nucleotide
ggcugagcuggggaccugguu

SEQ ID NO: 1069 - RNA, 21 nt, Artificial Sequence
  Description of Artificial Sequence: Synthetic oligonucleotide
  modified_base (20)..(21): 2'-methoxy-nucleotide
gcugagcuggggaccugguuu

SEQ ID NO: 1070 - RNA, 21 nt, Artificial Sequence
  Description of Artificial Sequence: Synthetic oligonucleotide
  modified_base (20)..(21): 2'-methoxy-nucleotide
cugagcuggggaccugguauu

SEQ ID NO: 1071 - RNA, 21 nt, Artificial Sequence
  Description of Artificial Sequence: Synthetic oligonucleotide
  modified_base (20)..(21): 2'-methoxy-nucleotide
ugagcuggggaccugguacuu

SEQ ID NO: 1072 - RNA, 21 nt, Artificial Sequence
  Description of Artificial Sequence: Synthetic oligonucleotide
  modified_base (20)..(21): 2'-methoxy-nucleotide
gagcuggggaccugguaccuu

SEQ ID NO: 1073 - RNA, 21 nt, Artificial Sequence
  Description of Artificial Sequence: Synthetic oligonucleotide
  modified_base (20)..(21): 2'-methoxy-nucleotide
agcuggggaccugguacccuu

SEQ ID NO: 1074 - RNA, 21 nt, Artificial Sequence
  Description of Artificial Sequence: Synthetic oligonucleotide
  modified_base (20)..(21): 2'-methoxy-nucleotide
gcuggggaccugguacccuuu

SEQ ID NO: 1075 - RNA, 21 nt, Artificial Sequence
  Description of Artificial Sequence: Synthetic oligonucleotide
  modified_base (20)..(21): 2'-methoxy-nucleotide
cuggggaccugguacccucuu

SEQ ID NO: 1076 - RNA, 21 nt, Artificial Sequence
  Description of Artificial Sequence: Synthetic oligonucleotide
  modified_base (20)..(21): 2'-methoxy-nucleotide
uggggaccugguacccuccuu

SEQ ID NO: 1077 - RNA, 21 nt, Artificial Sequence
  Description of Artificial Sequence: Synthetic oligonucleotide
  modified_base (20)..(21): 2'-methoxy-nucleotide
ggggaccugguacccuccuuu

SEQ ID NO: 1078 - RNA, 21 nt, Artificial Sequence
  Description of Artificial Sequence: Synthetic oligonucleotide
  modified_base (20)..(21): 2'-methoxy-nucleotide
gggaccugguacccuccuguu

SEQ ID NO: 1079 - RNA, 21 nt, Artificial Sequence
  Description of Artificial Sequence: Synthetic oligonucleotide
  modified_base (20)..(21): 2'-methoxy-nucleotide
ggaccugguacccuccugguu

SEQ ID NO: 1080 - RNA, 21 nt, Artificial Sequence
  Description of Artificial Sequence: Synthetic oligonucleotide
  modified_base (20)..(21): 2'-methoxy-nucleotide
gaccugguacccuccuggcuu

SEQ ID NO: 1081 - RNA, 21 nt, Artificial Sequence
  Description of Artificial Sequence: Synthetic oligonucleotide
  modified_base (20)..(21): 2'-methoxy-nucleotide
accugguacccuccuggcuuu

SEQ ID NO: 1082 - RNA, 21 nt, Artificial Sequence
  Description of Artificial Sequence: Synthetic oligonucleotide
  modified_base (20)..(21): 2'-methoxy-nucleotide
ccugguacccuccuggcucuu

SEQ ID NO: 1083 - RNA, 21 nt, Artificial Sequence
  Description of Artificial Sequence: Synthetic oligonucleotide
  modified_base (20)..(21): 2'-methoxy-nucleotide
cugguacccuccuggcucuuu

SEQ ID NO: 1084 - RNA, 21 nt, Artificial Sequence
  Description of Artificial Sequence: Synthetic oligonucleotide
  modified_base (20)..(21): 2'-methoxy-nucleotide
ugguacccuccuggcucuuuu

SEQ ID NO: 1085 - RNA, 21 nt, Artificial Sequence
  Description of Artificial Sequence: Synthetic oligonucleotide
  modified_base (20)..(21): 2'-methoxy-nucleotide
gguacccuccuggcucuuguu

SEQ ID NO: 1086 - RNA, 21 nt, Artificial Sequence
  Description of Artificial Sequence: Synthetic oligonucleotide
  modified_base (20)..(21): 2'-methoxy-nucleotide
guacccuccuggcucuugauu

SEQ ID NO: 1087 - RNA, 21 nt, Artificial Sequence
  Description of Artificial Sequence: Synthetic oligonucleotide
  modified_base (20)..(21): 2'-methoxy-nucleotide
uacccuccuggcucuugauuu

SEQ ID NO: 1088 - RNA, 21 nt, Artificial Sequence
  Description of Artificial Sequence: Synthetic oligonucleotide
  modified_base (20)..(21): 2'-methoxy-nucleotide
acccuccuggcucuugauauu

SEQ ID NO: 1089 - RNA, 21 nt, Artificial Sequence
  Description of Artificial Sequence: Synthetic oligonucleotide
  modified_base (20)..(21): 2'-methoxy-nucleotide
cccuccuggcucuugauacuu

SEQ ID NO: 1090 - RNA, 21 nt, Artificial Sequence
  Description of Artificial Sequence: Synthetic oligonucleotide
  modified_base (20)..(21): 2'-methoxy-nucleotide
ccuccuggcucuugauaccuu

SEQ ID NO: 1091 - RNA, 21 nt, Artificial Sequence
  Description of Artificial Sequence: Synthetic oligonucleotide
  modified_base (20)..(21): 2'-methoxy-nucleotide
cuccuggcucuugauacccuu

SEQ ID NO: 1092 - RNA, 21 nt, Artificial Sequence
  Description of Artificial Sequence: Synthetic oligonucleotide
  modified_base (20)..(21): 2'-methoxy-nucleotide
uccuggcucuugauaccccuu

SEQ ID NO: 1093 - RNA, 21 nt, Artificial Sequence
  Description of Artificial Sequence: Synthetic oligonucleotide
  modified_base (20)..(21): 2'-methoxy-nucleotide
ccuggcucuugauacccccuu

SEQ ID NO: 1094 - RNA, 21 nt, Artificial Sequence
  Description of Artificial Sequence: Synthetic oligonucleotide
  modified_base (20)..(21): 2'-methoxy-nucleotide
cuggcucuugauaccccccuu

SEQ ID NO: 1095 - RNA, 21 nt, Artificial Sequence
  Description of Artificial Sequence: Synthetic oligonucleotide
  modified_base (20)..(21): 2'-methoxy-nucleotide
uggcucuugauaccccccuuu

SEQ ID NO: 1096 - RNA, 21 nt, Artificial Sequence
  Description of Artificial Sequence: Synthetic oligonucleotide
  modified_base (20)..(21): 2'-methoxy-nucleotide
ggcucuugauaccccccucuu

SEQ ID NO: 1097 - RNA, 21 nt, Artificial Sequence
  Description of Artificial Sequence: Synthetic oligonucleotide
  modified_base (20)..(21): 2'-methoxy-nucleotide
gcucuugauaccccccucuuu

SEQ ID NO: 1098 - RNA, 21 nt, Artificial Sequence
  Description of Artificial Sequence: Synthetic oligonucleotide
  modified_base (20)..(21): 2'-methoxy-nucleotide
cucuugauaccccccucuguu

SEQ ID NO: 1099 - RNA, 21 nt, Artificial Sequence
  Description of Artificial Sequence: Synthetic oligonucleotide
  modified_base (20)..(21): 2'-methoxy-nucleotide
ucuugauaccccccucuguuu

SEQ ID NO: 1100 - RNA, 21 nt, Artificial Sequence
  Description of Artificial Sequence: Synthetic oligonucleotide
  modified_base (20)..(21): 2'-methoxy-nucleotide
cuugauaccccccucugucuu

SEQ ID NO: 1101 - RNA, 21 nt, Artificial Sequence
  Description of Artificial Sequence: Synthetic oligonucleotide
  modified_base (20)..(21): 2'-methoxy-nucleotide
uugauaccccccucugucuuu

SEQ ID NO: 1102 - RNA, 21 nt, Artificial Sequence
  Description of Artificial Sequence: Synthetic oligonucleotide
  modified_base (20)..(21): 2'-methoxy-nucleotide
ugauaccccccucugucuuuu

SEQ ID NO: 1103 - RNA, 21 nt, Artificial Sequence
  Description of Artificial Sequence: Synthetic oligonucleotide
  modified_base (20)..(21): 2'-methoxy-nucleotide
gauaccccccucugucuuguu

SEQ ID NO: 1104 - RNA, 21 nt, Artificial Sequence
  Description of Artificial Sequence: Synthetic oligonucleotide
  modified_base (20)..(21): 2'-methoxy-nucleotide
auaccccccucugucuuguuu

SEQ ID NO: 1105 - RNA, 21 nt, Artificial Sequence
  Description of Artificial Sequence: Synthetic oligonucleotide
  modified_base (20)..(21): 2'-methoxy-nucleotide
uaccccccucugucuuguguu

SEQ ID NO: 1106 - RNA, 21 nt, Artificial Sequence
  Description of Artificial Sequence: Synthetic oligonucleotide
  modified_base (20)..(21): 2'-methoxy-nucleotide
accccccucugucuugugauu

SEQ ID NO: 1107 - RNA, 21 nt, Artificial Sequence
  Description of Artificial Sequence: Synthetic oligonucleotide
  modified_base (20)..(21): 2'-methoxy-nucleotide
ccccccucugucuugugaauu

SEQ ID NO: 1108 - RNA, 21 nt, Artificial Sequence
  Description of Artificial Sequence: Synthetic oligonucleotide
  modified_base (20)..(21): 2'-methoxy-nucleotide
cccccucugucuugugaaguu

SEQ ID NO: 1109 - RNA, 21 nt, Artificial Sequence
  Description of Artificial Sequence: Synthetic oligonucleotide
  modified_base (20)..(21): 2'-methoxy-nucleotide
ccccucugucuugugaagguu

SEQ ID NO: 1110 - RNA, 21 nt, Artificial Sequence
  Description of Artificial Sequence: Synthetic oligonucleotide
  modified_base (20)..(21): 2'-methoxy-nucleotide
cccucugucuugugaaggcuu

SEQ ID NO: 1111 - RNA, 21 nt, Artificial Sequence
  Description of Artificial Sequence: Synthetic oligonucleotide
  modified_base (20)..(21): 2'-methoxy-nucleotide
ccucugucuugugaaggcauu

SEQ ID NO: 1112 - RNA, 21 nt, Artificial Sequence
  Description of Artificial Sequence: Synthetic oligonucleotide
  modified_base (20)..(21): 2'-methoxy-nucleotide
cucugucuugugaaggcaguu

SEQ ID NO: 1113 - RNA, 21 nt, Artificial Sequence
  Description of Artificial Sequence: Synthetic oligonucleotide
  modified_base (20)..(21): 2'-methoxy-nucleotide
ucugucuugugaaggcagguu

SEQ ID NO: 1114 - RNA, 21 nt, Artificial Sequence
  Description of Artificial Sequence: Synthetic oligonucleotide
  modified_base (20)..(21): 2'-methoxy-nucleotide
cugucuugugaaggcaggguu

SEQ ID NO: 1115 - RNA, 21 nt, Artificial Sequence
  Description of Artificial Sequence: Synthetic oligonucleotide
  modified_base (20)..(21): 2'-methoxy-nucleotide
ugucuugugaaggcagggguu

SEQ ID NO: 1116 - RNA, 21 nt, Artificial Sequence
  Description of Artificial Sequence: Synthetic oligonucleotide
  modified_base (20)..(21): 2'-methoxy-nucleotide
gucuugugaaggcaggggguu

SEQ ID NO: 1117 - RNA, 21 nt, Artificial Sequence
  Description of Artificial Sequence: Synthetic oligonucleotide
  modified_base (20)..(21): 2'-methoxy-nucleotide
ucuugugaaggcagggggauu

SEQ ID NO: 1118 - RNA, 21 nt, Artificial Sequence
  Description of Artificial Sequence: Synthetic oligonucleotide
  modified_base (20)..(21): 2'-methoxy-nucleotide
cuugugaaggcagggggaauu

SEQ ID NO: 1119 - RNA, 21 nt, Artificial Sequence
  Description of Artificial Sequence: Synthetic oligonucleotide
  modified_base (20)..(21): 2'-methoxy-nucleotide
uugugaaggcagggggaaguu

SEQ ID NO: 1120 - RNA, 21 nt, Artificial Sequence
  Description of Artificial Sequence: Synthetic oligonucleotide
  modified_base (20)..(21): 2'-methoxy-nucleotide
ugugaaggcagggggaagguu

SEQ ID NO: 1121 - RNA, 21 nt, Artificial Sequence
  Description of Artificial Sequence: Synthetic oligonucleotide
  modified_base (20)..(21): 2'-methoxy-nucleotide
gugaaggcagggggaagguuu

SEQ ID NO: 1122 - RNA, 21 nt, Artificial Sequence
  Description of Artificial Sequence: Synthetic oligonucleotide
  modified_base (20)..(21): 2'-methoxy-nucleotide
ugaaggcagggggaagguguu

SEQ ID NO: 1123 - RNA, 21 nt, Artificial Sequence
  Description of Artificial Sequence: Synthetic oligonucleotide
  modified_base (20)..(21): 2'-methoxy-nucleotide
gaaggcagggggaaggugguu

SEQ ID NO: 1124 - RNA, 21 nt, Artificial Sequence
  Description of Artificial Sequence: Synthetic oligonucleotide
  modified_base (20)..(21): 2'-methoxy-nucleotide
aaggcagggggaagguggguu

SEQ ID NO: 1125 - RNA, 21 nt, Artificial Sequence
  Description of Artificial Sequence: Synthetic oligonucleotide
  modified_base (20)..(21): 2'-methoxy-nucleotide
aggcagggggaaggugggguu

SEQ ID NO: 1126 - RNA, 21 nt, Artificial Sequence
  Description of Artificial Sequence: Synthetic oligonucleotide
  modified_base (20)..(21): 2'-methoxy-nucleotide
ggcagggggaaggugggguuu

SEQ ID NO: 1127 - RNA, 21 nt, Artificial Sequence
  Description of Artificial Sequence: Synthetic oligonucleotide
  modified_base (20)..(21): 2'-methoxy-nucleotide
gcagggggaagguggggucuu

SEQ ID NO: 1128 - RNA, 21 nt, Artificial Sequence
  Description of Artificial Sequence: Synthetic oligonucleotide
  modified_base (20)..(21): 2'-methoxy-nucleotide
cagggggaaggugggguccuu

SEQ ID NO: 1129 - RNA, 21 nt, Artificial Sequence
  Description of Artificial Sequence: Synthetic oligonucleotide
  modified_base (20)..(21): 2'-methoxy-nucleotide
agggggaaggugggguccuuu

SEQ ID NO: 1130 - RNA, 21 nt, Artificial Sequence
  Description of Artificial Sequence: Synthetic oligonucleotide
  modified_base (20)..(21): 2'-methoxy-nucleotide
gggggaaggugggguccuguu

SEQ ID NO: 1131 - RNA, 21 nt, Artificial Sequence
  Description of Artificial Sequence: Synthetic oligonucleotide
  modified_base (20)..(21): 2'-methoxy-nucleotide
ggggaaggugggguccugguu

SEQ ID NO: 1132 - RNA, 21 nt, Artificial Sequence
  Description of Artificial Sequence: Synthetic oligonucleotide
  modified_base (20)..(21): 2'-methoxy-nucleotide
gggaaggugggguccuggauu

SEQ ID NO: 1133 - RNA, 21 nt, Artificial Sequence
  Description of Artificial Sequence: Synthetic oligonucleotide
  modified_base (20)..(21): 2'-methoxy-nucleotide
ggaaggugggguccuggaguu

SEQ ID NO: 1134 - RNA, 21 nt, Artificial Sequence
  Description of Artificial Sequence: Synthetic oligonucleotide
  modified_base (20)..(21): 2'-methoxy-nucleotide
gaaggugggguccuggagcuu

SEQ ID NO: 1135 - RNA, 21 nt, Artificial Sequence
  Description of Artificial Sequence: Synthetic oligonucleotide
  modified_base (20)..(21): 2'-methoxy-nucleotide
aaggugggguccuggagcauu

SEQ ID NO: 1136 - RNA, 21 nt, Artificial Sequence
  Description of Artificial Sequence: Synthetic oligonucleotide
  modified_base (20)..(21): 2'-methoxy-nucleotide
aggugggguccuggagcaguu

SEQ ID NO: 1137 - RNA, 21 nt, Artificial Sequence
  Description of Artificial Sequence: Synthetic oligonucleotide
  modified_base (20)..(21): 2'-methoxy-nucleotide
ggugggguccuggagcagauu

SEQ ID NO: 1138 - RNA, 21 nt, Artificial Sequence
  Description of Artificial Sequence: Synthetic oligonucleotide
  modified_base (20)..(21): 2'-methoxy-nucleotide
gugggguccuggagcagacuu

SEQ ID NO: 1139 - RNA, 21 nt, Artificial Sequence
  Description of Artificial Sequence: Synthetic oligonucleotide
  modified_base (20)..(21): 2'-methoxy-nucleotide
ugggguccuggagcagaccuu

SEQ ID NO: 1140 - RNA, 21 nt, Artificial Sequence
  Description of Artificial Sequence: Synthetic oligonucleotide
  modified_base (20)..(21): 2'-methoxy-nucleotide
gggguccuggagcagaccauu

SEQ ID NO: 1141 - RNA, 21 nt, Artificial Sequence
  Description of Artificial Sequence: Synthetic oligonucleotide
  modified_base (20)..(21): 2'-methoxy-nucleotide
ggguccuggagcagaccacuu

SEQ ID NO: 1142 - RNA, 21 nt, Artificial Sequence
  Description of Artificial Sequence: Synthetic oligonucleotide
  modified_base (20)..(21): 2'-methoxy-nucleotide
gguccuggagcagaccaccuu

SEQ ID NO: 1143 - RNA, 21 nt, Artificial Sequence
  Description of Artificial Sequence: Synthetic oligonucleotide
  modified_base (20)..(21): 2'-methoxy-nucleotide
guccuggagcagaccacccuu

SEQ ID NO: 1144 - RNA, 21 nt, Artificial Sequence
  Description of Artificial Sequence: Synthetic oligonucleotide
  modified_base (20)..(21): 2'-methoxy-nucleotide
uccuggagcagaccaccccuu

SEQ ID NO: 1145 - RNA, 21 nt, Artificial Sequence
  Description of Artificial Sequence: Synthetic oligonucleotide
  modified_base (20)..(21): 2'-methoxy-nucleotide
ccuggagcagaccaccccguu

SEQ ID NO: 1146 - RNA, 21 nt, Artificial Sequence
  Description of Artificial Sequence: Synthetic oligonucleotide
  modified_base (20)..(21): 2'-methoxy-nucleotide
cuggagcagaccaccccgcuu

SEQ ID NO: 1147 - RNA, 21 nt, Artificial Sequence
  Description of Artificial Sequence: Synthetic oligonucleotide
  modified_base (20)..(21): 2'-methoxy-nucleotide
uggagcagaccaccccgccuu

SEQ ID NO: 1148 - RNA, 21 nt, Artificial Sequence
  Description of Artificial Sequence: Synthetic oligonucleotide
  modified_base (20)..(21): 2'-methoxy-nucleotide
ggagcagaccaccccgccuuu

SEQ ID NO: 1149 - RNA, 21 nt, Artificial Sequence
  Description of Artificial Sequence: Synthetic oligonucleotide
  modified_base (20)..(21): 2'-methoxy-nucleotide
gagcagaccaccccgccuguu

SEQ ID NO: 1150 - RNA, 21 nt, Artificial Sequence
  Description of Artificial Sequence: Synthetic oligonucleotide
  modified_base (20)..(21): 2'-methoxy-nucleotide
agcagaccaccccgccugcuu

SEQ ID NO: 1151 - RNA, 21 nt, Artificial Sequence
  Description of Artificial Sequence: Synthetic oligonucleotide
  modified_base (20)..(21): 2'-methoxy-nucleotide
gcagaccaccccgccugccuu

SEQ ID NO: 1152 - RNA, 21 nt, Artificial Sequence
  Description of Artificial Sequence: Synthetic oligonucleotide
  modified_base (20)..(21): 2'-methoxy-nucleotide
cagaccaccccgccugcccuu

SEQ ID NO: 1153 - RNA, 21 nt, Artificial Sequence
  Description of Artificial Sequence: Synthetic oligonucleotide
  modified_base (20)..(21): 2'-methoxy-nucleotide
agaccaccccgccugcccuuu

SEQ ID NO: 1154 - RNA, 21 nt, Artificial Sequence
  Description of Artificial Sequence: Synthetic oligonucleotide
  modified_base (20)..(21): 2'-methoxy-nucleotide
gaccaccccgccugcccucuu

SEQ ID NO: 1155 - RNA, 21 nt, Artificial Sequence
  Description of Artificial Sequence: Synthetic oligonucleotide
  modified_base (20)..(21): 2'-methoxy-nucleotide
accaccccgccugcccucauu

SEQ ID NO: 1156 - RNA, 21 nt, Artificial Sequence
  Description of Artificial Sequence: Synthetic oligonucleotide
  modified_base (20)..(21): 2'-methoxy-nucleotide
ccaccccgccugcccucauuu

SEQ ID NO: 1157 - RNA, 21 nt, Artificial Sequence
  Description of Artificial Sequence: Synthetic oligonucleotide
  modified_base (20)..(21): 2'-methoxy-nucleotide
caccccgccugcccucauguu

SEQ ID NO: 1158 - RNA, 21 nt, Artificial Sequence
  Description of Artificial Sequence: Synthetic oligonucleotide
  modified_base (20)..(21): 2'-methoxy-nucleotide
accccgccugcccucaugguu

SEQ ID NO: 1159 - RNA, 21 nt, Artificial Sequence
  Description of Artificial Sequence: Synthetic oligonucleotide
  modified_base (20)..(21): 2'-methoxy-nucleotide
ccccgccugcccucauggcuu

SEQ ID NO: 1160 - RNA, 21 nt, Artificial Sequence
  Description of Artificial Sequence: Synthetic oligonucleotide
  modified_base (20)..(21): 2'-methoxy-nucleotide
cccgccugcccucauggccuu

SEQ ID NO: 1161 - RNA, 21 nt, Artificial Sequence
  Description of Artificial Sequence: Synthetic oligonucleotide
  modified_base (20)..(21): 2'-methoxy-nucleotide
ccgccugcccucauggcccuu

SEQ ID NO: 1162 - RNA, 21 nt, Artificial Sequence
  Description of Artificial Sequence: Synthetic oligonucleotide
  modified_base (20)..(21): 2'-methoxy-nucleotide
cgccugcccucauggccccuu

SEQ ID NO: 1163 - RNA, 21 nt, Artificial Sequence
  Description of Artificial Sequence: Synthetic oligonucleotide
  modified_base (20)..(21): 2'-methoxy-nucleotide
gccugcccucauggccccuuu

SEQ ID NO: 1164 - RNA, 21 nt, Artificial Sequence
  Description of Artificial Sequence: Synthetic oligonucleotide
  modified_base (20)..(21): 2'-methoxy-nucleotide
ccugcccucauggccccucuu

SEQ ID NO: 1165 - RNA, 21 nt, Artificial Sequence
  Description of Artificial Sequence: Synthetic oligonucleotide
  modified_base (20)..(21): 2'-methoxy-nucleotide
cugcccucauggccccucuuu

SEQ ID NO: 1166 - RNA, 21 nt, Artificial Sequence
  Description of Artificial Sequence: Synthetic oligonucleotide
  modified_base (20)..(21): 2'-methoxy-nucleotide
ugcccucauggccccucuguu

SEQ ID NO: 1167 - RNA, 21 nt, Artificial Sequence
  Description of Artificial Sequence: Synthetic oligonucleotide
  modified_base (20)..(21): 2'-methoxy-nucleotide
gcccucauggccccucugauu

SEQ ID NO: 1168 - RNA, 21 nt, Artificial Sequence
  Description of Artificial Sequence: Synthetic oligonucleotide
  modified_base (20)..(21): 2'-methoxy-nucleotide
cccucauggccccucugacuu

SEQ ID NO: 1169 - RNA, 21 nt, Artificial Sequence
  Description of Artificial Sequence: Synthetic oligonucleotide
  modified_base (20)..(21): 2'-methoxy-nucleotide
ccucauggccccucugaccuu

SEQ ID NO: 1170 - RNA, 21 nt, Artificial Sequence
  Description of Artificial Sequence: Synthetic oligonucleotide
  modified_base (20)..(21): 2'-methoxy-nucleotide
cucauggccccucugaccuuu

SEQ ID NO: 1171 - RNA, 21 nt, Artificial Sequence
  Description of Artificial Sequence: Synthetic oligonucleotide
  modified_base (20)..(21): 2'-methoxy-nucleotide
ucauggccccucugaccuguu

SEQ ID NO: 1172 - RNA, 21 nt, Artificial Sequence
  Description of Artificial Sequence: Synthetic oligonucleotide
  modified_base (20)..(21): 2'-methoxy-nucleotide
cauggccccucugaccugcuu

SEQ ID NO: 1173 - RNA, 21 nt, Artificial Sequence
  Description of Artificial Sequence: Synthetic oligonucleotide
  modified_base (20)..(21): 2'-methoxy-nucleotide
auggccccucugaccugcauu

SEQ ID NO: 1174 - RNA, 21 nt, Artificial Sequence
  Description of Artificial Sequence: Synthetic oligonucleotide
  modified_base (20)..(21): 2'-methoxy-nucleotide
uggccccucugaccugcacuu

SEQ ID NO: 1175 - RNA, 21 nt, Artificial Sequence
  Description of Artificial Sequence: Synthetic oligonucleotide
  modified_base (20)..(21): 2'-methoxy-nucleotide
ggccccucugaccugcacuuu

SEQ ID NO: 1176 - RNA, 21 nt, Artificial Sequence
  Description of Artificial Sequence: Synthetic oligonucleotide
  modified_base (20)..(21): 2'-methoxy-nucleotide
gccccucugaccugcacuguu

SEQ ID NO: 1177 - RNA, 21 nt, Artificial Sequence
  Description of Artificial Sequence: Synthetic oligonucleotide
  modified_base (20)..(21): 2'-methoxy-nucleotide
ccccucugaccugcacugguu

SEQ ID NO: 1178 - RNA, 21 nt, Artificial Sequence
  Description of Artificial Sequence: Synthetic oligonucleotide
  modified_base (20)..(21): 2'-methoxy-nucleotide
cccucugaccugcacuggguu

SEQ ID NO: 1179 - RNA, 21 nt, Artificial Sequence
  Description of Artificial Sequence: Synthetic oligonucleotide
  modified_base (20)..(21): 2'-methoxy-nucleotide
ccucugaccugcacugggguu

SEQ ID NO: 1180 - RNA, 21 nt, Artificial Sequence
  Description of Artificial Sequence: Synthetic oligonucleotide
  modified_base (20)..(21): 2'-methoxy-nucleotide
cucugaccugcacuggggauu

SEQ ID NO: 1181 - RNA, 21 nt, Artificial Sequence
  Description of Artificial Sequence: Synthetic oligonucleotide
  modified_base (20)..(21): 2'-methoxy-nucleotide
ucugaccugcacuggggaguu

SEQ ID NO: 1182 - RNA, 21 nt, Artificial Sequence
  Description of Artificial Sequence: Synthetic oligonucleotide
  modified_base (20)..(21): 2'-methoxy-nucleotide
cugaccugcacuggggagcuu

SEQ ID NO: 1183 - RNA, 21 nt, Artificial Sequence
  Description of Artificial Sequence: Synthetic oligonucleotide
  modified_base (20)..(21): 2'-methoxy-nucleotide
ugaccugcacuggggagccuu

SEQ ID NO: 1184 - RNA, 21 nt, Artificial Sequence
  Description of Artificial Sequence: Synthetic oligonucleotide
  modified_base (20)..(21): 2'-methoxy-nucleotide
gaccugcacuggggagcccuu

SEQ ID NO: 1185 - RNA, 21 nt, Artificial Sequence
  Description of Artificial Sequence: Synthetic oligonucleotide
  modified_base (20)..(21): 2'-methoxy-nucleotide
accugcacuggggagcccguu

SEQ ID NO: 1186 - RNA, 21 nt, Artificial Sequence
  Description of Artificial Sequence: Synthetic oligonucleotide
  modified_base (20)..(21): 2'-methoxy-nucleotide
ccugcacuggggagcccguuu

SEQ ID NO: 1187 - RNA, 21 nt, Artificial Sequence
  Description of Artificial Sequence: Synthetic oligonucleotide
  modified_base (20)..(21): 2'-methoxy-nucleotide
cugcacuggggagcccgucuu

SEQ ID NO: 1188 - RNA, 21 nt, Artificial Sequence
  Description of Artificial Sequence: Synthetic oligonucleotide
  modified_base (20)..(21): 2'-methoxy-nucleotide
ugcacuggggagcccgucuuu

SEQ ID NO: 1189 - RNA, 21 nt, Artificial Sequence
  Description of Artificial Sequence: Synthetic oligonucleotide
  modified_base (20)..(21): 2'-methoxy-nucleotide
gcacuggggagcccgucucuu

SEQ ID NO: 1190 - RNA, 21 nt, Artificial Sequence
  Description of Artificial Sequence: Synthetic oligonucleotide
  modified_base (20)..(21): 2'-methoxy-nucleotide
cacuggggagcccgucucauu

SEQ ID NO: 1191 - RNA, 21 nt, Artificial Sequence
  Description of Artificial Sequence: Synthetic oligonucleotide
  modified_base (20)..(21): 2'-methoxy-nucleotide
acuggggagcccgucucaguu

SEQ ID NO: 1192 - RNA, 21 nt, Artificial Sequence
  Description of Artificial Sequence: Synthetic oligonucleotide
  modified_base (20)..(21): 2'-methoxy-nucleotide
cuggggagcccgucucaguuu

SEQ ID NO: 1193 - RNA, 21 nt, Artificial Sequence
  Description of Artificial Sequence: Synthetic oligonucleotide
  modified_base (20)..(21): 2'-methoxy-nucleotide
uggggagcccgucucaguguu

SEQ ID NO: 1194 - RNA, 21 nt, Artificial Sequence
  Description of Artificial Sequence: Synthetic oligonucleotide
  modified_base (20)..(21): 2'-methoxy-nucleotide
ggggagcccgucucaguguuu

SEQ ID NO: 1195 - RNA, 21 nt, Artificial Sequence
  Description of Artificial Sequence: Synthetic oligonucleotide
  modified_base (20)..(21): 2'-methoxy-nucleotide
gggagcccgucucaguguuuu

SEQ ID NO: 1196 - RNA, 21 nt, Artificial Sequence
  Description of Artificial Sequence: Synthetic oligonucleotide
  modified_base (20)..(21): 2'-methoxy-nucleotide
ggagcccgucucaguguuguu

SEQ ID NO: 1197 - RNA, 21 nt, Artificial Sequence
  Description of Artificial Sequence: Synthetic oligonucleotide
  modified_base (20)..(21): 2'-methoxy-nucleotide
gagcccgucucaguguugauu

SEQ ID NO: 1198 - RNA, 21 nt, Artificial Sequence
  Description of Artificial Sequence: Synthetic oligonucleotide
  modified_base (20)..(21): 2'-methoxy-nucleotide
agcccgucucaguguugaguu

SEQ ID NO: 1199 - RNA, 21 nt, Artificial Sequence
  Description of Artificial Sequence: Synthetic oligonucleotide
  modified_base (20)..(21): 2'-methoxy-nucleotide
gcccgucucaguguugagcuu

SEQ ID NO: 1200 - RNA, 21 nt, Artificial Sequence
  Description of Artificial Sequence: Synthetic oligonucleotide
  modified_base (20)..(21): 2'-methoxy-nucleotide
cccgucucaguguugagccuu

SEQ ID NO: 1201 - RNA, 21 nt, Artificial Sequence
  Description of Artificial Sequence: Synthetic oligonucleotide
  modified_base (20)..(21): 2'-methoxy-nucleotide
ccgucucaguguugagccuuu

SEQ ID NO: 1202 - RNA, 21 nt, Artificial Sequence
  Description of Artificial Sequence: Synthetic oligonucleotide
  modified_base (20)..(21): 2'-methoxy-nucleotide
cgucucaguguugagccuuuu

SEQ ID NO: 1203 - RNA, 21 nt, Artificial Sequence
  Description of Artificial Sequence: Synthetic oligonucleotide
  modified_base (20)..(21): 2'-methoxy-nucleotide
gucucaguguugagccuuuuu

SEQ ID NO: 1204 - RNA, 21 nt, Artificial Sequence
  Description of Artificial Sequence: Synthetic oligonucleotide
  modified_base (20)..(21): 2'-methoxy-nucleotide
ucucaguguugagccuuuuuu

SEQ ID NO: 1205 - RNA, 21 nt, Artificial Sequence
  Description of Artificial Sequence: Synthetic oligonucleotide
  modified_base (20)..(21): 2'-methoxy-nucleotide
cucaguguugagccuuuucuu

SEQ ID NO: 1206 - RNA, 21 nt, Artificial Sequence
  Description of Artificial Sequence: Synthetic oligonucleotide
  modified_base (20)..(21): 2'-methoxy-nucleotide
ucaguguugagccuuuuccuu

SEQ ID NO: 1207 - RNA, 21 nt, Artificial Sequence
  Description of Artificial Sequence: Synthetic oligonucleotide
  modified_base (20)..(21): 2'-methoxy-nucleotide
caguguugagccuuuucccuu

SEQ ID NO: 1208 - RNA, 21 nt, Artificial Sequence
  Description of Artificial Sequence: Synthetic oligonucleotide
  modified_base (20)..(21): 2'-methoxy-nucleotide
aguguugagccuuuucccuuu

SEQ ID NO: 1209 - RNA, 21 nt, Artificial Sequence
  Description of Artificial Sequence: Synthetic oligonucleotide
  modified_base (20)..(21): 2'-methoxy-nucleotide
guguugagccuuuucccucuu

SEQ ID NO: 1210 - RNA, 21 nt, Artificial Sequence
  Description of Artificial Sequence: Synthetic oligonucleotide
  modified_base (20)..(21): 2'-methoxy-nucleotide
uguugagccuuuucccucuuu

SEQ ID NO: 1211 - RNA, 21 nt, Artificial Sequence
  Description of Artificial Sequence: Synthetic oligonucleotide
  modified_base (20)..(21): 2'-methoxy-nucleotide
guugagccuuuucccucuuuu

SEQ ID NO: 1212 - RNA, 21 nt, Artificial Sequence
  Description of Artificial Sequence: Synthetic oligonucleotide
  modified_base (20)..(21): 2'-methoxy-nucleotide
uugagccuuuucccucuuuuu

SEQ ID NO: 1213 - RNA, 21 nt, Artificial Sequence
  Description of Artificial Sequence: Synthetic oligonucleotide
  modified_base (20)..(21): 2'-methoxy-nucleotide
ugagccuuuucccucuuuguu

SEQ ID NO: 1214 - RNA, 21 nt, Artificial Sequence
  Description of Artificial Sequence: Synthetic oligonucleotide
  modified_base (20)..(21): 2'-methoxy-nucleotide
gagccuuuucccucuuugguu

SEQ ID NO: 1215 - RNA, 21 nt, Artificial Sequence
  Description of Artificial Sequence: Synthetic oligonucleotide
  modified_base (20)..(21): 2'-methoxy-nucleotide
agccuuuucccucuuuggcuu

SEQ ID NO: 1216 - RNA, 21 nt, Artificial Sequence
  Description of Artificial Sequence: Synthetic oligonucleotide
  modified_base (20)..(21): 2'-methoxy-nucleotide
gccuuuucccucuuuggcuuu

SEQ ID NO: 1217 - RNA, 21 nt, Artificial Sequence
  Description of Artificial Sequence: Synthetic oligonucleotide
  modified_base (20)..(21): 2'-methoxy-nucleotide
ccuuuucccucuuuggcucuu

SEQ ID NO: 1218 - RNA, 21 nt, Artificial Sequence
  Description of Artificial Sequence: Synthetic oligonucleotide
  modified_base (20)..(21): 2'-methoxy-nucleotide
cuuuucccucuuuggcuccuu

SEQ ID NO: 1219 - RNA, 21 nt, Artificial Sequence
  Description of Artificial Sequence: Synthetic oligonucleotide
  modified_base (20)..(21): 2'-methoxy-nucleotide
uuuucccucuuuggcucccuu

SEQ ID NO: 1220 - RNA, 21 nt, Artificial Sequence
  Description of Artificial Sequence: Synthetic oligonucleotide
  modified_base (20)..(21): 2'-methoxy-nucleotide
uuucccucuuuggcuccccuu

SEQ ID NO: 1221 - RNA, 21 nt, Artificial Sequence
  Description of Artificial Sequence: Synthetic oligonucleotide
  modified_base (20)..(21): 2'-methoxy-nucleotide
uucccucuuuggcuccccuuu

SEQ ID NO: 1222 - RNA, 21 nt, Artificial Sequence
  Description of Artificial Sequence: Synthetic oligonucleotide
  modified_base (20)..(21): 2'-methoxy-nucleotide
ucccucuuuggcuccccuguu

SEQ ID NO: 1223 - RNA, 21 nt, Artificial Sequence
  Description of Artificial Sequence: Synthetic oligonucleotide
  modified_base (20)..(21): 2'-methoxy-nucleotide
cccucuuuggcuccccuguuu

SEQ ID NO: 1224 - RNA, 21 nt, Artificial Sequence
  Description of Artificial Sequence: Synthetic oligonucleotide
  modified_base (20)..(21): 2'-methoxy-nucleotide
ccucuuuggcuccccuguauu

SEQ ID NO: 1225 - RNA, 21 nt, Artificial Sequence
  Description of Artificial Sequence: Synthetic oligonucleotide
  modified_base (20)..(21): 2'-methoxy-nucleotide
cucuuuggcuccccuguacuu

SEQ ID NO: 1226 - RNA, 21 nt, Artificial Sequence
  Description of Artificial Sequence: Synthetic oligonucleotide
  modified_base (20)..(21): 2'-methoxy-nucleotide
ucuuuggcuccccuguaccuu

SEQ ID NO: 1227 - RNA, 21 nt, Artificial Sequence
  Description of Artificial Sequence: Synthetic oligonucleotide
  modified_base (20)..(21): 2'-methoxy-nucleotide
cuuuggcuccccuguaccuuu

SEQ ID NO: 1228 - RNA, 21 nt, Artificial Sequence
  Description of Artificial Sequence: Synthetic oligonucleotide
  modified_base (20)..(21): 2'-methoxy-nucleotide
uuuggcuccccuguaccuuuu

SEQ ID NO: 1229 - RNA, 21 nt, Artificial Sequence
  Description of Artificial Sequence: Synthetic oligonucleotide
  modified_base (20)..(21): 2'-methoxy-nucleotide
uuggcuccccuguaccuuuuu

SEQ ID NO: 1230 - RNA, 21 nt, Artificial Sequence
  Description of Artificial Sequence: Synthetic oligonucleotide
  modified_base (20)..(21): 2'-methoxy-nucleotide
uggcuccccuguaccuuuuuu

SEQ ID NO: 1231 - RNA, 21 nt, Artificial Sequence
  Description of Artificial Sequence: Synthetic oligonucleotide
  modified_base (20)..(21): 2'-methoxy-nucleotide
ggcuccccuguaccuuuuguu

SEQ ID NO: 1232 - RNA, 21 nt, Artificial Sequence
  Description of Artificial Sequence: Synthetic oligonucleotide
  modified_base (20)..(21): 2'-methoxy-nucleotide
gcuccccuguaccuuuugauu

SEQ ID NO: 1233 - RNA, 21 nt, Artificial Sequence
  Description of Artificial Sequence: Synthetic oligonucleotide
  modified_base (20)..(21): 2'-methoxy-nucleotide
cuccccuguaccuuuugaguu

SEQ ID NO: 1234 - RNA, 21 nt, Artificial Sequence
  Description of Artificial Sequence: Synthetic oligonucleotide
  modified_base (20)..(21): 2'-methoxy-nucleotide
uccccuguaccuuuugagguu

SEQ ID NO: 1235 - RNA, 21 nt, Artificial Sequence
  Description of Artificial Sequence: Synthetic oligonucleotide
  modified_base (20)..(21): 2'-methoxy-nucleotide
ccccuguaccuuuugaggauu

SEQ ID NO: 1236 - RNA, 21 nt, Artificial Sequence
  Description of Artificial Sequence: Synthetic oligonucleotide
  modified_base (20)..(21): 2'-methoxy-nucleotide
cccuguaccuuuugaggaguu

SEQ ID NO: 1237 - RNA, 21 nt, Artificial Sequence
  Description of Artificial Sequence: Synthetic oligonucleotide
  modified_base (20)..(21): 2'-methoxy-nucleotide
ccuguaccuuuugaggagcuu

SEQ ID NO: 1238 - RNA, 21 nt, Artificial Sequence
  Description of Artificial Sequence: Synthetic oligonucleotide
  modified_base (20)..(21): 2'-methoxy-nucleotide
cuguaccuuuugaggagccuu

SEQ ID NO: 1239 - RNA, 21 nt, Artificial Sequence
  Description of Artificial Sequence: Synthetic oligonucleotide
  modified_base (20)..(21): 2'-methoxy-nucleotide
uguaccuuuugaggagcccuu

SEQ ID NO: 1240 - RNA, 21 nt, Artificial Sequence
  Description of Artificial Sequence: Synthetic oligonucleotide
  modified_base (20)..(21): 2'-methoxy-nucleotide
guaccuuuugaggagccccuu

SEQ ID NO: 1241 - RNA, 21 nt, Artificial Sequence
  Description of Artificial Sequence: Synthetic oligonucleotide
  modified_base (20)..(21): 2'-methoxy-nucleotide
uaccuuuugaggagccccauu

SEQ ID NO: 1242 - RNA, 21 nt, Artificial Sequence
  Description of Artificial Sequence: Synthetic oligonucleotide
  modified_base (20)..(21): 2'-methoxy-nucleotide
accuuuugaggagccccaguu

SEQ ID NO: 1243 - RNA, 21 nt, Artificial Sequence
  Description of Artificial Sequence: Synthetic oligonucleotide
  modified_base (20)..(21): 2'-methoxy-nucleotide
ccuuuugaggagccccagcuu

SEQ ID NO: 1244 - RNA, 21 nt, Artificial Sequence
  Description of Artificial Sequence: Synthetic oligonucleotide
  modified_base (20)..(21): 2'-methoxy-nucleotide
cuuuugaggagccccagcuuu

SEQ ID NO: 1245 - RNA, 21 nt, Artificial Sequence
  Description of Artificial Sequence: Synthetic oligonucleotide
  modified_base (20)..(21): 2'-methoxy-nucleotide
uuuugaggagccccagcuauu

SEQ ID NO: 1246 - RNA, 21 nt, Artificial Sequence
  Description of Artificial Sequence: Synthetic oligonucleotide
  modified_base (20)..(21): 2'-methoxy-nucleotide
uuugaggagccccagcuacuu

SEQ ID NO: 1247 - RNA, 21 nt, Artificial Sequence
  Description of Artificial Sequence: Synthetic oligonucleotide
  modified_base (20)..(21): 2'-methoxy-nucleotide
uugaggagccccagcuaccuu

SEQ ID NO: 1248 - RNA, 21 nt, Artificial Sequence
  Description of Artificial Sequence: Synthetic oligonucleotide
  modified_base (20)..(21): 2'-methoxy-nucleotide
ugaggagccccagcuacccuu

SEQ ID NO: 1249 - RNA, 21 nt, Artificial Sequence
  Description of Artificial Sequence: Synthetic oligonucleotide
  modified_base (20)..(21): 2'-methoxy-nucleotide
gaggagccccagcuacccuuu

SEQ ID NO: 1250 - RNA, 21 nt, Artificial Sequence
  Description of Artificial Sequence: Synthetic oligonucleotide
  modified_base (20)..(21): 2'-methoxy-nucleotide
aggagccccagcuacccuuuu

SEQ ID NO: 1251 - RNA, 21 nt, Artificial Sequence
  Description of Artificial Sequence: Synthetic oligonucleotide
  modified_base (20)..(21): 2'-methoxy-nucleotide
ggagccccagcuacccuucuu

SEQ ID NO: 1252 - RNA, 21 nt, Artificial Sequence
  Description of Artificial Sequence: Synthetic oligonucleotide
  modified_base (20)..(21): 2'-methoxy-nucleotide
gagccccagcuacccuucuuu

SEQ ID NO: 1253 - RNA, 21 nt, Artificial Sequence
  Description of Artificial Sequence: Synthetic oligonucleotide
  modified_base (20)..(21): 2'-methoxy-nucleotide
agccccagcuacccuucuuuu

SEQ ID NO: 1254 - RNA, 21 nt, Artificial Sequence
  Description of Artificial Sequence: Synthetic oligonucleotide
  modified_base (20)..(21): 2'-methoxy-nucleotide
gccccagcuacccuucuucuu

SEQ ID NO: 1255 - RNA, 21 nt, Artificial Sequence
  Description of Artificial Sequence: Synthetic oligonucleotide
  modified_base (20)..(21): 2'-methoxy-nucleotide
ccccagcuacccuucuucuuu

SEQ ID NO: 1256 - RNA, 21 nt, Artificial Sequence
  Description of Artificial Sequence: Synthetic oligonucleotide
  modified_base (20)..(21): 2'-methoxy-nucleotide
cccagcuacccuucuucucuu

SEQ ID NO: 1257 - RNA, 21 nt, Artificial Sequence
  Description of Artificial Sequence: Synthetic oligonucleotide
  modified_base (20)..(21): 2'-methoxy-nucleotide
ccagcuacccuucuucuccuu

SEQ ID NO: 1258 - RNA, 21 nt, Artificial Sequence
  Description of Artificial Sequence: Synthetic oligonucleotide
  modified_base (20)..(21): 2'-methoxy-nucleotide
cagcuacccuucuucuccauu

SEQ ID NO: 1259 - RNA, 21 nt, Artificial Sequence
  Description of Artificial Sequence: Synthetic oligonucleotide
  modified_base (20)..(21): 2'-methoxy-nucleotide
agcuacccuucuucuccaguu

SEQ ID NO: 1260 - RNA, 21 nt, Artificial Sequence
  Description of Artificial Sequence: Synthetic oligonucleotide
  modified_base (20)..(21): 2'-methoxy-nucleotide
gcuacccuucuucuccagcuu

SEQ ID NO: 1261 - RNA, 21 nt, Artificial Sequence
  Description of Artificial Sequence: Synthetic oligonucleotide
  modified_base (20)..(21): 2'-methoxy-nucleotide
cuacccuucuucuccagcuuu

SEQ ID NO: 1262 - RNA, 21 nt, Artificial Sequence
  Description of Artificial Sequence: Synthetic oligonucleotide
  modified_base (20)..(21): 2'-methoxy-nucleotide
uacccuucuucuccagcuguu

SEQ ID NO: 1263 - RNA, 21 nt, Artificial Sequence
  Description of Artificial Sequence: Synthetic oligonucleotide
  modified_base (20)..(21): 2'-methoxy-nucleotide
acccuucuucuccagcugguu

SEQ ID NO: 1264 - RNA, 21 nt, Artificial Sequence
  Description of Artificial Sequence: Synthetic oligonucleotide
  modified_base (20)..(21): 2'-methoxy-nucleotide
cccuucuucuccagcuggguu

SEQ ID NO: 1265 - RNA, 21 nt, Artificial Sequence
  Description of Artificial Sequence: Synthetic oligonucleotide
  modified_base (20)..(21): 2'-methoxy-nucleotide
ccuucuucuccagcugggcuu

SEQ ID NO: 1266 - RNA, 21 nt, Artificial Sequence
  Description of Artificial Sequence: Synthetic oligonucleotide
  modified_base (20)..(21): 2'-methoxy-nucleotide
cuucuucuccagcugggcuuu

SEQ ID NO: 1267 - RNA, 21 nt, Artificial Sequence
  Description of Artificial Sequence: Synthetic oligonucleotide
  modified_base (20)..(21): 2'-methoxy-nucleotide
uucuucuccagcugggcucuu

SEQ ID NO: 1268 - RNA, 21 nt, Artificial Sequence
  Description of Artificial Sequence: Synthetic oligonucleotide
  modified_base (20)..(21): 2'-methoxy-nucleotide
ucuucuccagcugggcucuuu

SEQ ID NO: 1269 - RNA, 21 nt, Artificial Sequence
  Description of Artificial Sequence: Synthetic oligonucleotide
  modified_base (20)..(21): 2'-methoxy-nucleotide
cuucuccagcugggcucuguu

SEQ ID NO: 1270 - RNA, 21 nt, Artificial Sequence
  Description of Artificial Sequence: Synthetic oligonucleotide
  modified_base (20)..(21): 2'-methoxy-nucleotide
uucuccagcugggcucugcuu

SEQ ID NO: 1271 - RNA, 21 nt, Artificial Sequence
  Description of Artificial Sequence: Synthetic oligonucleotide
  modified_base (20)..(21): 2'-methoxy-nucleotide
ucuccagcugggcucugcauu

SEQ ID NO: 1272 - RNA, 21 nt, Artificial Sequence
  Description of Artificial Sequence: Synthetic oligonucleotide
  modified_base (20)..(21): 2'-methoxy-nucleotide
cuccagcugggcucugcaauu

SEQ ID NO: 1273 - RNA, 21 nt, Artificial Sequence
  Description of Artificial Sequence: Synthetic oligonucleotide
  modified_base (20)..(21): 2'-methoxy-nucleotide
uccagcugggcucugcaauuu

SEQ ID NO: 1274 - RNA, 21 nt, Artificial Sequence
  Description of Artificial Sequence: Synthetic oligonucleotide
  modified_base (20)..(21): 2'-methoxy-nucleotide
ccagcugggcucugcaauuuu

SEQ ID NO: 1275 - RNA, 21 nt, Artificial Sequence
  Description of Artificial Sequence: Synthetic oligonucleotide
  modified_base (20)..(21): 2'-methoxy-nucleotide
cagcugggcucugcaauucuu

SEQ ID NO: 1276 - RNA, 21 nt, Artificial Sequence
  Description of Artificial Sequence: Synthetic oligonucleotide
  modified_base (20)..(21): 2'-methoxy-nucleotide
agcugggcucugcaauuccuu

SEQ ID NO: 1277 - RNA, 21 nt, Artificial Sequence
  Description of Artificial Sequence: Synthetic oligonucleotide
  modified_base (20)..(21): 2'-methoxy-nucleotide
gcugggcucugcaauucccuu

SEQ ID NO: 1278 - RNA, 21 nt, Artificial Sequence
  Description of Artificial Sequence: Synthetic oligonucleotide
  modified_base (20)..(21): 2'-methoxy-nucleotide
cugggcucugcaauuccccuu

SEQ ID NO: 1279 - RNA, 21 nt, Artificial Sequence
  Description of Artificial Sequence: Synthetic oligonucleotide
  modified_base (20)..(21): 2'-methoxy-nucleotide
ugggcucugcaauuccccuuu

SEQ ID NO: 1280 - RNA, 21 nt, Artificial Sequence
  Description of Artificial Sequence: Synthetic oligonucleotide
  modified_base (20)..(21): 2'-methoxy-nucleotide
gggcucugcaauuccccucuu

SEQ ID NO: 1281 - RNA, 21 nt, Artificial Sequence
  Description of Artificial Sequence: Synthetic oligonucleotide
  modified_base (20)..(21): 2'-methoxy-nucleotide
ggcucugcaauuccccucuuu

SEQ ID NO: 1282 - RNA, 21 nt, Artificial Sequence
  Description of Artificial Sequence: Synthetic oligonucleotide
  modified_base (20)..(21): 2'-methoxy-nucleotide
gcucugcaauuccccucuguu

SEQ ID NO: 1283 - RNA, 21 nt, Artificial Sequence
  Description of Artificial Sequence: Synthetic oligonucleotide
  modified_base (20)..(21): 2'-methoxy-nucleotide
cucugcaauuccccucugcuu

SEQ ID NO: 1284 - RNA, 21 nt, Artificial Sequence
  Description of Artificial Sequence: Synthetic oligonucleotide
  modified_base (20)..(21): 2'-methoxy-nucleotide
ucugcaauuccccucugcuuu

SEQ ID NO: 1285 - RNA, 21 nt, Artificial Sequence
  Description of Artificial Sequence: Synthetic oligonucleotide
  modified_base (20)..(21): 2'-methoxy-nucleotide
cugcaauuccccucugcuguu

SEQ ID NO: 1286 - RNA, 21 nt, Artificial Sequence
  Description of Artificial Sequence: Synthetic oligonucleotide
  modified_base (20)..(21): 2'-methoxy-nucleotide
ugcaauuccccucugcugcuu

SEQ ID NO: 1287 - RNA, 21 nt, Artificial Sequence
  Description of Artificial Sequence: Synthetic oligonucleotide
  modified_base (20)..(21): 2'-methoxy-nucleotide
gcaauuccccucugcugcuuu

SEQ ID NO: 1288 - RNA, 21 nt, Artificial Sequence
  Description of Artificial Sequence: Synthetic oligonucleotide
  modified_base (20)..(21): 2'-methoxy-nucleotide
caauuccccucugcugcuguu

SEQ ID NO: 1289 - RNA, 21 nt, Artificial Sequence
  Description of Artificial Sequence: Synthetic oligonucleotide
  modified_base (20)..(21): 2'-methoxy-nucleotide
aauuccccucugcugcuguuu

SEQ ID NO: 1290 - RNA, 21 nt, Artificial Sequence
  Description of Artificial Sequence: Synthetic oligonucleotide
  modified_base (20)..(21): 2'-methoxy-nucleotide
auuccccucugcugcugucuu

SEQ ID NO: 1291 - RNA, 21 nt, Artificial Sequence
  Description of Artificial Sequence: Synthetic oligonucleotide
  modified_base (20)..(21): 2'-methoxy-nucleotide
uuccccucugcugcuguccuu

SEQ ID NO: 1292 - RNA, 21 nt, Artificial Sequence
  Description of Artificial Sequence: Synthetic oligonucleotide
  modified_base (20)..(21): 2'-methoxy-nucleotide
uccccucugcugcugucccuu

SEQ ID NO: 1293 - RNA, 21 nt, Artificial Sequence
  Description of Artificial Sequence: Synthetic oligonucleotide
  modified_base (20)..(21): 2'-methoxy-nucleotide
ccccucugcugcugucccuuu

SEQ ID NO: 1294 - RNA, 21 nt, Artificial Sequence
  Description of Artificial Sequence: Synthetic oligonucleotide
  modified_base (20)..(21): 2'-methoxy-nucleotide
cccucugcugcugucccucuu

SEQ ID NO: 1295 - RNA, 21 nt, Artificial Sequence
  Description of Artificial Sequence: Synthetic oligonucleotide
  modified_base (20)..(21): 2'-methoxy-nucleotide
ccucugcugcugucccuccuu

SEQ ID NO: 1296 - RNA, 21 nt, Artificial Sequence
  Description of Artificial Sequence: Synthetic oligonucleotide
  modified_base (20)..(21): 2'-methoxy-nucleotide
cucugcugcugucccucccuu

SEQ ID NO: 1297 - RNA, 21 nt, Artificial Sequence
  Description of Artificial Sequence: Synthetic oligonucleotide
  modified_base (20)..(21): 2'-methoxy-nucleotide
ucugcugcugucccuccccuu

SEQ ID NO: 1298 - RNA, 21 nt, Artificial Sequence
  Description of Artificial Sequence: Synthetic oligonucleotide
  modified_base (20)..(21): 2'-methoxy-nucleotide
cugcugcugucccucccccuu

SEQ ID NO: 1299 - RNA, 21 nt, Artificial Sequence
  Description of Artificial Sequence: Synthetic oligonucleotide
  modified_base (20)..(21): 2'-methoxy-nucleotide
ugcugcugucccucccccuuu

SEQ ID NO: 1300 - RNA, 21 nt, Artificial Sequence
  Description of Artificial Sequence: Synthetic oligonucleotide
  modified_base (20)..(21): 2'-methoxy-nucleotide
gcugcugucccucccccuuuu

SEQ ID NO: 1301 - RNA, 21 nt, Artificial Sequence
  Description of Artificial Sequence: Synthetic oligonucleotide
  modified_base (20)..(21): 2'-methoxy-nucleotide
cugcugucccucccccuuguu

SEQ ID NO: 1302 - RNA, 21 nt, Artificial Sequence
  Description of Artificial Sequence: Synthetic oligonucleotide
  modified_base (20)..(21): 2'-methoxy-nucleotide
ugcugucccucccccuuguuu

SEQ ID NO: 1303 - RNA, 21 nt, Artificial Sequence
  Description of Artificial Sequence: Synthetic oligonucleotide
  modified_base (20)..(21): 2'-methoxy-nucleotide
gcugucccucccccuugucuu

SEQ ID NO: 1304 - RNA, 21 nt, Artificial Sequence
  Description of Artificial Sequence: Synthetic oligonucleotide
  modified_base (20)..(21): 2'-methoxy-nucleotide
cugucccucccccuuguccuu

SEQ ID NO: 1305 - RNA, 21 nt, Artificial Sequence
  Description of Artificial Sequence: Synthetic oligonucleotide
  modified_base (20)..(21): 2'-methoxy-nucleotide
ugucccucccccuuguccuuu

SEQ ID NO: 1306 - RNA, 21 nt, Artificial Sequence
  Description of Artificial Sequence: Synthetic oligonucleotide
  modified_base (20)..(21): 2'-methoxy-nucleotide
gucccucccccuuguccuuuu

SEQ ID NO: 1307 - RNA, 21 nt, Artificial Sequence
  Description of Artificial Sequence: Synthetic oligonucleotide
  modified_base (20)..(21): 2'-methoxy-nucleotide
ucccucccccuuguccuuuuu

SEQ ID NO: 1308 - RNA, 21 nt, Artificial Sequence
  Description of Artificial Sequence: Synthetic oligonucleotide
  modified_base (20)..(21): 2'-methoxy-nucleotide
cccucccccuuguccuuucuu

SEQ ID NO: 1309 - RNA, 21 nt, Artificial Sequence
  Description of Artificial Sequence: Synthetic oligonucleotide
  modified_base (20)..(21): 2'-methoxy-nucleotide
ccucccccuuguccuuuccuu

SEQ ID NO: 1310 - RNA, 21 nt, Artificial Sequence
  Description of Artificial Sequence: Synthetic oligonucleotide
  modified_base (20)..(21): 2'-methoxy-nucleotide
cucccccuuguccuuucccuu

SEQ ID NO: 1311 - RNA, 21 nt, Artificial Sequence
  Description of Artificial Sequence: Synthetic oligonucleotide
  modified_base (20)..(21): 2'-methoxy-nucleotide
ucccccuuguccuuucccuuu

SEQ ID NO: 1312 - RNA, 21 nt, Artificial Sequence
  Description of Artificial Sequence: Synthetic oligonucleotide
  modified_base (20)..(21): 2'-methoxy-nucleotide
cccccuuguccuuucccuuuu

SEQ ID NO: 1313 - RNA, 21 nt, Artificial Sequence
  Description of Artificial Sequence: Synthetic oligonucleotide
  modified_base (20)..(21): 2'-methoxy-nucleotide
ccccuuguccuuucccuucuu

SEQ ID NO: 1314 - RNA, 21 nt, Artificial Sequence
  Description of Artificial Sequence: Synthetic oligonucleotide
  modified_base (20)..(21): 2'-methoxy-nucleotide
cccuuguccuuucccuucauu

SEQ ID NO: 1315 - RNA, 21 nt, Artificial Sequence
  Description of Artificial Sequence: Synthetic oligonucleotide
  modified_base (20)..(21): 2'-methoxy-nucleotide
ccuuguccuuucccuucaguu

SEQ ID NO: 1316 - RNA, 21 nt, Artificial Sequence
  Description of Artificial Sequence: Synthetic oligonucleotide
  modified_base (20)..(21): 2'-methoxy-nucleotide
cuuguccuuucccuucaguuu

SEQ ID NO: 1317 - RNA, 21 nt, Artificial Sequence
  Description of Artificial Sequence: Synthetic oligonucleotide
  modified_base (20)..(21): 2'-methoxy-nucleotide
uuguccuuucccuucaguauu

SEQ ID NO: 1318 - RNA, 21 nt, Artificial Sequence
  Description of Artificial Sequence: Synthetic oligonucleotide
  modified_base (20)..(21): 2'-methoxy-nucleotide
uguccuuucccuucaguacuu

SEQ ID NO: 1319 - RNA, 21 nt, Artificial Sequence
  Description of Artificial Sequence: Synthetic oligonucleotide
  modified_base (20)..(21): 2'-methoxy-nucleotide
guccuuucccuucaguaccuu

SEQ ID NO: 1320 - RNA, 21 nt, Artificial Sequence
  Description of Artificial Sequence: Synthetic oligonucleotide
  modified_base (20)..(21): 2'-methoxy-nucleotide
uccuuucccuucaguacccuu

SEQ ID NO: 1321 - RNA, 21 nt, Artificial Sequence
  Description of Artificial Sequence: Synthetic oligonucleotide
  modified_base (20)..(21): 2'-methoxy-nucleotide
ccuuucccuucaguacccuuu

SEQ ID NO: 1322 - RNA, 21 nt, Artificial Sequence
  Description of Artificial Sequence: Synthetic oligonucleotide
  modified_base (20)..(21): 2'-methoxy-nucleotide
cuuucccuucaguacccucuu

SEQ ID NO: 1323 - RNA, 21 nt, Artificial Sequence
  Description of Artificial Sequence: Synthetic oligonucleotide
  modified_base (20)..(21): 2'-methoxy-nucleotide
uuucccuucaguacccucuuu

SEQ ID NO: 1324 - RNA, 21 nt, Artificial Sequence
  Description of Artificial Sequence: Synthetic oligonucleotide
  modified_base (20)..(21): 2'-methoxy-nucleotide
uucccuucaguacccucucuu

SEQ ID NO: 1325 - RNA, 21 nt, Artificial Sequence
  Description of Artificial Sequence: Synthetic oligonucleotide
  modified_base (20)..(21): 2'-methoxy-nucleotide
ucccuucaguacccucucauu

SEQ ID NO: 1326 - RNA, 21 nt, Artificial Sequence
  Description of Artificial Sequence: Synthetic oligonucleotide
  modified_base (20)..(21): 2'-methoxy-nucleotide
cccuucaguacccucucaguu

SEQ ID NO: 1327 - RNA, 21 nt, Artificial Sequence
  Description of Artificial Sequence: Synthetic oligonucleotide
  modified_base (20)..(21): 2'-methoxy-nucleotide
ccuucaguacccucucagcuu

SEQ ID NO: 1328 - RNA, 21 nt, Artificial Sequence
  Description of Artificial Sequence: Synthetic oligonucleotide
  modified_base (20)..(21): 2'-methoxy-nucleotide
cuucaguacccucucagcuuu

SEQ ID NO: 1329 - RNA, 21 nt, Artificial Sequence
  Description of Artificial Sequence: Synthetic oligonucleotide
  modified_base (20)..(21): 2'-methoxy-nucleotide
uucaguacccucucagcucuu

SEQ ID NO: 1330 - RNA, 21 nt, Artificial Sequence
  Description of Artificial Sequence: Synthetic oligonucleotide
  modified_base (20)..(21): 2'-methoxy-nucleotide
ucaguacccucucagcuccuu

SEQ ID NO: 1331 - RNA, 21 nt, Artificial Sequence
  Description of Artificial Sequence: Synthetic oligonucleotide
  modified_base (20)..(21): 2'-methoxy-nucleotide
caguacccucucagcuccauu

SEQ ID NO: 1332 - RNA, 21 nt, Artificial Sequence
  Description of Artificial Sequence: Synthetic oligonucleotide
  modified_base (20)..(21): 2'-methoxy-nucleotide
aguacccucucagcuccaguu

SEQ ID NO: 1333 - RNA, 21 nt, Artificial Sequence
  Description of Artificial Sequence: Synthetic oligonucleotide
  modified_base (20)..(21): 2'-methoxy-nucleotide
guacccucucagcuccagguu

SEQ ID NO: 1334 - RNA, 21 nt, Artificial Sequence
  Description of Artificial Sequence: Synthetic oligonucleotide
  modified_base (20)..(21): 2'-methoxy-nucleotide
uacccucucagcuccagguuu

SEQ ID NO: 1335 - RNA, 21 nt, Artificial Sequence
  Description of Artificial Sequence: Synthetic oligonucleotide
  modified_base (20)..(21): 2'-methoxy-nucleotide
acccucucagcuccagguguu

SEQ ID NO: 1336 - RNA, 21 nt, Artificial Sequence
  Description of Artificial Sequence: Synthetic oligonucleotide
  modified_base (20)..(21): 2'-methoxy-nucleotide
cccucucagcuccaggugguu

SEQ ID NO: 1337 - RNA, 21 nt, Artificial Sequence
  Description of Artificial Sequence: Synthetic oligonucleotide
  modified_base (20)..(21): 2'-methoxy-nucleotide
ccucucagcuccagguggcuu

SEQ ID NO: 1338 - RNA, 21 nt, Artificial Sequence
  Description of Artificial Sequence: Synthetic oligonucleotide
  modified_base (20)..(21): 2'-methoxy-nucleotide
cucucagcuccagguggcuuu

SEQ ID NO: 1339 - RNA, 21 nt, Artificial Sequence
  Description of Artificial Sequence: Synthetic oligonucleotide
  modified_base (20)..(21): 2'-methoxy-nucleotide
ucucagcuccagguggcucuu

SEQ ID NO: 1340 - RNA, 21 nt, Artificial Sequence
  Description of Artificial Sequence: Synthetic oligonucleotide
  modified_base (20)..(21): 2'-methoxy-nucleotide
cucagcuccagguggcucuuu

SEQ ID NO: 1341 - RNA, 21 nt, Artificial Sequence
  Description of Artificial Sequence: Synthetic oligonucleotide
  modified_base (20)..(21): 2'-methoxy-nucleotide
ucagcuccagguggcucuguu

SEQ ID NO: 1342 - RNA, 21 nt, Artificial Sequence
  Description of Artificial Sequence: Synthetic oligonucleotide
  modified_base (20)..(21): 2'-methoxy-nucleotide
cagcuccagguggcucugauu

SEQ ID NO: 1343 - RNA, 21 nt, Artificial Sequence
  Description of Artificial Sequence: Synthetic oligonucleotide
  modified_base (20)..(21): 2'-methoxy-nucleotide
agcuccagguggcucugaguu

SEQ ID NO: 1344 - RNA, 21 nt, Artificial Sequence
  Description of Artificial Sequence: Synthetic oligonucleotide
  modified_base (20)..(21): 2'-methoxy-nucleotide
gcuccagguggcucugagguu

SEQ ID NO: 1345 - RNA, 21 nt, Artificial Sequence
  Description of Artificial Sequence: Synthetic oligonucleotide
  modified_base (20)..(21): 2'-methoxy-nucleotide
cuccagguggcucugagguuu

SEQ ID NO: 1346 - RNA, 21 nt, Artificial Sequence
  Description of Artificial Sequence: Synthetic oligonucleotide
  modified_base (20)..(21): 2'-methoxy-nucleotide
uccagguggcucugagguguu

SEQ ID NO: 1347 - RNA, 21 nt, Artificial Sequence
  Description of Artificial Sequence: Synthetic oligonucleotide
  modified_base (20)..(21): 2'-methoxy-nucleotide
ccagguggcucugaggugcuu

SEQ ID NO: 1348 - RNA, 21 nt, Artificial Sequence
  Description of Artificial Sequence: Synthetic oligonucleotide
  modified_base (20)..(21): 2'-methoxy-nucleotide
cagguggcucugaggugccuu

SEQ ID NO: 1349 - RNA, 21 nt, Artificial Sequence
  Description of Artificial Sequence: Synthetic oligonucleotide
  modified_base (20)..(21): 2'-methoxy-nucleotide
agguggcucugaggugccuuu

SEQ ID NO: 1350 - RNA, 21 nt, Artificial Sequence
  Description of Artificial Sequence: Synthetic oligonucleotide
  modified_base (20)..(21): 2'-methoxy-nucleotide
gguggcucugaggugccuguu

SEQ ID NO: 1351 - RNA, 21 nt, Artificial Sequence
  Description of Artificial Sequence: Synthetic oligonucleotide
  modified_base (20)..(21): 2'-methoxy-nucleotide
guggcucugaggugccuguuu

SEQ ID NO: 1352 - RNA, 21 nt, Artificial Sequence
  Description of Artificial Sequence: Synthetic oligonucleotide
  modified_base (20)..(21): 2'-methoxy-nucleotide
uggcucugaggugccugucuu

SEQ ID NO: 1353 - RNA, 21 nt, Artificial Sequence
  Description of Artificial Sequence: Synthetic oligonucleotide
  modified_base (20)..(21): 2'-methoxy-nucleotide
ggcucugaggugccuguccuu

SEQ ID NO: 1354 - RNA, 21 nt, Artificial Sequence
  Description of Artificial Sequence: Synthetic oligonucleotide
  modified_base (20)..(21): 2'-methoxy-nucleotide
gcucugaggugccugucccuu

SEQ ID NO: 1355 - RNA, 21 nt, Artificial Sequence
  Description of Artificial Sequence: Synthetic oligonucleotide
  modified_base (20)..(21): 2'-methoxy-nucleotide
cucugaggugccugucccauu

SEQ ID NO: 1356 - RNA, 21 nt, Artificial Sequence
  Description of Artificial Sequence: Synthetic oligonucleotide
  modified_base (20)..(21): 2'-methoxy-nucleotide
ucugaggugccugucccacuu

SEQ ID NO: 1357 - RNA, 21 nt, Artificial Sequence
  Description of Artificial Sequence: Synthetic oligonucleotide
  modified_base (20)..(21): 2'-methoxy-nucleotide
cugaggugccugucccaccuu

SEQ ID NO: 1358 - RNA, 21 nt, Artificial Sequence
  Description of Artificial Sequence: Synthetic oligonucleotide
  modified_base (20)..(21): 2'-methoxy-nucleotide
ugaggugccugucccacccuu

SEQ ID NO: 1359 - RNA, 21 nt, Artificial Sequence
  Description of Artificial Sequence: Synthetic oligonucleotide
  modified_base (20)..(21): 2'-methoxy-nucleotide
gaggugccugucccaccccuu

SEQ ID NO: 1360 - RNA, 21 nt, Artificial Sequence
  Description of Artificial Sequence: Synthetic oligonucleotide
  modified_base (20)..(21): 2'-methoxy-nucleotide
aggugccugucccacccccuu

SEQ ID NO: 1361 - RNA, 21 nt, Artificial Sequence
  Description of Artificial Sequence: Synthetic oligonucleotide
  modified_base (20)..(21): 2'-methoxy-nucleotide
ggugccugucccacccccauu

SEQ ID NO: 1362 - RNA, 21 nt, Artificial Sequence
  Description of Artificial Sequence: Synthetic oligonucleotide
  modified_base (20)..(21): 2'-methoxy-nucleotide
gugccugucccacccccacuu

SEQ ID NO: 1363 - RNA, 21 nt, Artificial Sequence
  Description of Artificial Sequence: Synthetic oligonucleotide
  modified_base (20)..(21): 2'-methoxy-nucleotide
ugccugucccacccccaccuu

SEQ ID NO: 1364 - RNA, 21 nt, Artificial Sequence
  Description of Artificial Sequence: Synthetic oligonucleotide
  modified_base (20)..(21): 2'-methoxy-nucleotide
gccugucccacccccacccuu

SEQ ID NO: 1365 - RNA, 21 nt, Artificial Sequence
  Description of Artificial Sequence: Synthetic oligonucleotide
  modified_base (20)..(21): 2'-methoxy-nucleotide
ccugucccacccccaccccuu

SEQ ID NO: 1366 - RNA, 21 nt, Artificial Sequence
  Description of Artificial Sequence: Synthetic oligonucleotide
  modified_base (20)..(21): 2'-methoxy-nucleotide
cugucccacccccacccccuu

SEQ ID NO: 1367 - RNA, 21 nt, Artificial Sequence
  Description of Artificial Sequence: Synthetic oligonucleotide
  modified_base (20)..(21): 2'-methoxy-nucleotide
ugucccacccccacccccauu

SEQ ID NO: 1368 - RNA, 21 nt, Artificial Sequence
  Description of Artificial Sequence: Synthetic oligonucleotide
  modified_base (20)..(21): 2'-methoxy-nucleotide
gucccacccccacccccaguu

SEQ ID NO: 1369 - RNA, 21 nt, Artificial Sequence
  Description of Artificial Sequence: Synthetic oligonucleotide
  modified_base (20)..(21): 2'-methoxy-nucleotide
ucccacccccacccccagcuu

SEQ ID NO: 1370 - RNA, 21 nt, Artificial Sequence
  Description of Artificial Sequence: Synthetic oligonucleotide
  modified_base (20)..(21): 2'-methoxy-nucleotide
cccacccccacccccagcuuu

SEQ ID NO: 1371 - RNA, 21 nt, Artificial Sequence
  Description of Artificial Sequence: Synthetic oligonucleotide
  modified_base (20)..(21): 2'-methoxy-nucleotide
ccacccccacccccagcucuu

SEQ ID NO: 1372 - RNA, 21 nt, Artificial Sequence
  Description of Artificial Sequence: Synthetic oligonucleotide
  modified_base (20)..(21): 2'-methoxy-nucleotide
cacccccacccccagcucauu

SEQ ID NO: 1373 - RNA, 21 nt, Artificial Sequence
  Description of Artificial Sequence: Synthetic oligonucleotide
  modified_base (20)..(21): 2'-methoxy-nucleotide
acccccacccccagcucaauu

SEQ ID NO: 1374 - RNA, 21 nt, Artificial Sequence
  Description of Artificial Sequence: Synthetic oligonucleotide
  modified_base (20)..(21): 2'-methoxy-nucleotide
cccccacccccagcucaauuu

SEQ ID NO: 1375 - RNA, 21 nt, Artificial Sequence
  Description of Artificial Sequence: Synthetic oligonucleotide
  modified_base (20)..(21): 2'-methoxy-nucleotide
ccccacccccagcucaauguu

SEQ ID NO: 1376 - RNA, 21 nt, Artificial Sequence
  Description of Artificial Sequence: Synthetic oligonucleotide
  modified_base (20)..(21): 2'-methoxy-nucleotide
cccacccccagcucaaugguu

SEQ ID NO: 1377 - RNA, 21 nt, Artificial Sequence
  Description of Artificial Sequence: Synthetic oligonucleotide
  modified_base (20)..(21): 2'-methoxy-nucleotide
ccacccccagcucaauggauu

SEQ ID NO: 1378 - RNA, 21 nt, Artificial Sequence
  Description of Artificial Sequence: Synthetic oligonucleotide
  modified_base (20)..(21): 2'-methoxy-nucleotide
cacccccagcucaauggacuu

SEQ ID NO: 1379 - RNA, 21 nt, Artificial Sequence
  Description of Artificial Sequence: Synthetic oligonucleotide
  modified_base (20)..(21): 2'-methoxy-nucleotide
acccccagcucaauggacuuu

SEQ ID NO: 1380 - RNA, 21 nt, Artificial Sequence
  Description of Artificial Sequence: Synthetic oligonucleotide
  modified_base (20)..(21): 2'-methoxy-nucleotide
cccccagcucaauggacuguu

SEQ ID NO: 1381 - RNA, 21 nt, Artificial Sequence
  Description of Artificial Sequence: Synthetic oligonucleotide
  modified_base (20)..(21): 2'-methoxy-nucleotide
ccccagcucaauggacugguu

SEQ ID NO: 1382 - RNA, 21 nt, Artificial Sequence
  Description of Artificial Sequence: Synthetic oligonucleotide
  modified_base (20)..(21): 2'-methoxy-nucleotide
cccagcucaauggacuggauu

SEQ ID NO: 1383 - RNA, 21 nt, Artificial Sequence
  Description of Artificial Sequence: Synthetic oligonucleotide
  modified_base (20)..(21): 2'-methoxy-nucleotide
ccagcucaauggacuggaauu

SEQ ID NO: 1384 - RNA, 21 nt, Artificial Sequence
  Description of Artificial Sequence: Synthetic oligonucleotide
  modified_base (20)..(21): 2'-methoxy-nucleotide
cagcucaauggacuggaaguu

SEQ ID NO: 1385 - RNA, 21 nt, Artificial Sequence
  Description of Artificial Sequence: Synthetic oligonucleotide
  modified_base (20)..(21): 2'-methoxy-nucleotide
agcucaauggacuggaagguu

SEQ ID NO: 1386 - RNA, 21 nt, Artificial Sequence
  Description of Artificial Sequence: Synthetic oligonucleotide
  modified_base (20)..(21): 2'-methoxy-nucleotide
gcucaauggacuggaaggguu

SEQ ID NO: 1387 - RNA, 21 nt, Artificial Sequence
  Description of Artificial Sequence: Synthetic oligonucleotide
  modified_base (20)..(21): 2'-methoxy-nucleotide
cucaauggacuggaagggguu

SEQ ID NO: 1388 - RNA, 21 nt, Artificial Sequence
  Description of Artificial Sequence: Synthetic oligonucleotide
  modified_base (20)..(21): 2'-methoxy-nucleotide
ucaauggacuggaaggggauu

SEQ ID NO: 1389 - RNA, 21 nt, Artificial Sequence
  Description of Artificial Sequence: Synthetic oligonucleotide
  modified_base (20)..(21): 2'-methoxy-nucleotide
caauggacuggaaggggaauu

SEQ ID NO: 1390 - RNA, 21 nt, Artificial Sequence
  Description of Artificial Sequence: Synthetic oligonucleotide
  modified_base (20)..(21): 2'-methoxy-nucleotide
aauggacuggaaggggaaguu

SEQ ID NO: 1391 - RNA, 21 nt, Artificial Sequence
  Description of Artificial Sequence: Synthetic oligonucleotide
  modified_base (20)..(21): 2'-methoxy-nucleotide
auggacuggaaggggaagguu

SEQ ID NO: 1392 - RNA, 21 nt, Artificial Sequence
  Description of Artificial Sequence: Synthetic oligonucleotide
  modified_base (20)..(21): 2'-methoxy-nucleotide
uggacuggaaggggaaggguu

SEQ ID NO: 1393 - RNA, 21 nt, Artificial Sequence
  Description of Artificial Sequence: Synthetic oligonucleotide
  modified_base (20)..(21): 2'-methoxy-nucleotide
ggacuggaaggggaagggauu

SEQ ID NO: 1394 - RNA, 21 nt, Artificial Sequence
  Description of Artificial Sequence: Synthetic oligonucleotide
  modified_base (20)..(21): 2'-methoxy-nucleotide
gacuggaaggggaagggacuu

SEQ ID NO: 1395 - RNA, 21 nt, Artificial Sequence
  Description of Artificial Sequence: Synthetic oligonucleotide
  modified_base (20)..(21): 2'-methoxy-nucleotide
acuggaaggggaagggacauu

SEQ ID NO: 1396 - RNA, 21 nt, Artificial Sequence
  Description of Artificial Sequence: Synthetic oligonucleotide
  modified_base (20)..(21): 2'-methoxy-nucleotide
cuggaaggggaagggacacuu

SEQ ID NO: 1397 - RNA, 21 nt, Artificial Sequence
  Description of Artificial Sequence: Synthetic oligonucleotide
  modified_base (20)..(21): 2'-methoxy-nucleotide
uggaaggggaagggacacauu

SEQ ID NO: 1398 - RNA, 21 nt, Artificial Sequence
  Description of Artificial Sequence: Synthetic oligonucleotide
  modified_base (20)..(21): 2'-methoxy-nucleotide
ggaaggggaagggacacacuu

SEQ ID NO: 1399 - RNA, 21 nt, Artificial Sequence
  Description of Artificial Sequence: Synthetic oligonucleotide
  modified_base (20)..(21): 2'-methoxy-nucleotide
gaaggggaagggacacacauu

SEQ ID NO: 1400 - RNA, 21 nt, Artificial Sequence
  Description of Artificial Sequence: Synthetic oligonucleotide
  modified_base (20)..(21): 2'-methoxy-nucleotide
aaggggaagggacacacaauu

SEQ ID NO: 1401 - RNA, 21 nt, Artificial Sequence
  Description of Artificial Sequence: Synthetic oligonucleotide
  modified_base (20)..(21): 2'-methoxy-nucleotide
aggggaagggacacacaaguu

SEQ ID NO: 1402 - RNA, 21 nt, Artificial Sequence
  Description of Artificial Sequence: Synthetic oligonucleotide
  modified_base (20)..(21): 2'-methoxy-nucleotide
ggggaagggacacacaagauu

SEQ ID NO: 1403 - RNA, 21 nt, Artificial Sequence
  Description of Artificial Sequence: Synthetic oligonucleotide
  modified_base (20)..(21): 2'-methoxy-nucleotide
gggaagggacacacaagaauu

SEQ ID NO: 1404 - RNA, 21 nt, Artificial Sequence
  Description of Artificial Sequence: Synthetic oligonucleotide
  modified_base (20)..(21): 2'-methoxy-nucleotide
ggaagggacacacaagaaguu

SEQ ID NO: 1405 - RNA, 21 nt, Artificial Sequence
  Description of Artificial Sequence: Synthetic oligonucleotide
  modified_base (20)..(21): 2'-methoxy-nucleotide
gaagggacacacaagaagauu

SEQ ID NO: 1406 - RNA, 21 nt, Artificial Sequence
  Description of Artificial Sequence: Synthetic oligonucleotide
  modified_base (20)..(21): 2'-methoxy-nucleotide
aagggacacacaagaagaauu

SEQ ID NO: 1407 - RNA, 21 nt, Artificial Sequence
  Description of Artificial Sequence: Synthetic oligonucleotide
  modified_base (20)..(21): 2'-methoxy-nucleotide
agggacacacaagaagaaguu

SEQ ID NO: 1408 - RNA, 21 nt, Artificial Sequence
  Description of Artificial Sequence: Synthetic oligonucleotide
  modified_base (20)..(21): 2'-methoxy-nucleotide
gggacacacaagaagaagguu

SEQ ID NO: 1409 - RNA, 21 nt, Artificial Sequence
  Description of Artificial Sequence: Synthetic oligonucleotide
  modified_base (20)..(21): 2'-methoxy-nucleotide
ggacacacaagaagaaggguu

SEQ ID NO: 1410 - RNA, 21 nt, Artificial Sequence
  Description of Artificial Sequence: Synthetic oligonucleotide
  modified_base (20)..(21): 2'-methoxy-nucleotide
gacacacaagaagaagggcuu

SEQ ID NO: 1411 - RNA, 21 nt, Artificial Sequence
  Description of Artificial Sequence: Synthetic oligonucleotide
  modified_base (20)..(21): 2'-methoxy-nucleotide
acacacaagaagaagggcauu

SEQ ID NO: 1412 - RNA, 21 nt, Artificial Sequence
  Description of Artificial Sequence: Synthetic oligonucleotide
  modified_base (20)..(21): 2'-methoxy-nucleotide
cacacaagaagaagggcacuu

SEQ ID NO: 1413 - RNA, 21 nt, Artificial Sequence
  Description of Artificial Sequence: Synthetic oligonucleotide
  modified_base (20)..(21): 2'-methoxy-nucleotide
acacaagaagaagggcaccuu

SEQ ID NO: 1414 - RNA, 21 nt, Artificial Sequence
  Description of Artificial Sequence: Synthetic oligonucleotide
  modified_base (20)..(21): 2'-methoxy-nucleotide
cacaagaagaagggcacccuu

SEQ ID NO: 1415 - RNA, 21 nt, Artificial Sequence
  Description of Artificial Sequence: Synthetic oligonucleotide
  modified_base (20)..(21): 2'-methoxy-nucleotide
acaagaagaagggcacccuuu

SEQ ID NO: 1416 - RNA, 21 nt, Artificial Sequence
  Description of Artificial Sequence: Synthetic oligonucleotide
  modified_base (20)..(21): 2'-methoxy-nucleotide
caagaagaagggcacccuauu

SEQ ID NO: 1417 - RNA, 21 nt, Artificial Sequence
  Description of Artificial Sequence: Synthetic oligonucleotide
  modified_base (20)..(21): 2'-methoxy-nucleotide
aagaagaagggcacccuaguu

SEQ ID NO: 1418 - RNA, 21 nt, Artificial Sequence
  Description of Artificial Sequence: Synthetic oligonucleotide
  modified_base (20)..(21): 2'-methoxy-nucleotide
agaagaagggcacccuaguuu

SEQ ID NO: 1419 - RNA, 21 nt, Artificial Sequence
  Description of Artificial Sequence: Synthetic oligonucleotide
  modified_base (20)..(21): 2'-methoxy-nucleotide
gaagaagggcacccuaguuuu

SEQ ID NO: 1420 - RNA, 21 nt, Artificial Sequence
  Description of Artificial Sequence: Synthetic oligonucleotide
  modified_base (20)..(21): 2'-methoxy-nucleotide
aagaagggcacccuaguucuu

SEQ ID NO: 1421 - RNA, 21 nt, Artificial Sequence
  Description of Artificial Sequence: Synthetic oligonucleotide
  modified_base (20)..(21): 2'-methoxy-nucleotide
agaagggcacccuaguucuuu

SEQ ID NO: 1422 - RNA, 21 nt, Artificial Sequence
  Description of Artificial Sequence: Synthetic oligonucleotide
  modified_base (20)..(21): 2'-methoxy-nucleotide
gaagggcacccuaguucuauu

SEQ ID NO: 1423 - RNA, 21 nt, Artificial Sequence
  Description of Artificial Sequence: Synthetic oligonucleotide
  modified_base (20)..(21): 2'-methoxy-nucleotide
aagggcacccuaguucuacuu

SEQ ID NO: 1424 - RNA, 21 nt, Artificial Sequence
  Description of Artificial Sequence: Synthetic oligonucleotide
  modified_base (20)..(21): 2'-methoxy-nucleotide
agggcacccuaguucuaccuu

SEQ ID NO: 1425 - RNA, 21 nt, Artificial Sequence
  Description of Artificial Sequence: Synthetic oligonucleotide
  modified_base (20)..(21): 2'-methoxy-nucleotide
gggcacccuaguucuaccuuu

SEQ ID NO: 1426 - RNA, 21 nt, Artificial Sequence
  Description of Artificial Sequence: Synthetic oligonucleotide
  modified_base (20)..(21): 2'-methoxy-nucleotide
ggcacccuaguucuaccucuu

SEQ ID NO: 1427 - RNA, 21 nt, Artificial Sequence
  Description of Artificial Sequence: Synthetic oligonucleotide
  modified_base (20)..(21): 2'-methoxy-nucleotide
gcacccuaguucuaccucauu

SEQ ID NO: 1428 - RNA, 21 nt, Artificial Sequence
  Description of Artificial Sequence: Synthetic oligonucleotide
  modified_base (20)..(21): 2'-methoxy-nucleotide
cacccuaguucuaccucaguu

SEQ ID NO: 1429 - RNA, 21 nt, Artificial Sequence
  Description of Artificial Sequence: Synthetic oligonucleotide
  modified_base (20)..(21): 2'-methoxy-nucleotide
acccuaguucuaccucagguu

SEQ ID NO: 1430 - RNA, 21 nt, Artificial Sequence
  Description of Artificial Sequence: Synthetic oligonucleotide
  modified_base (20)..(21): 2'-methoxy-nucleotide
cccuaguucuaccucaggcuu

SEQ ID NO: 1431 - RNA, 21 nt, Artificial Sequence
  Description of Artificial Sequence: Synthetic oligonucleotide
  modified_base (20)..(21): 2'-methoxy-nucleotide
ccuaguucuaccucaggcauu

SEQ ID NO: 1432 - RNA, 21 nt, Artificial Sequence
  Description of Artificial Sequence: Synthetic oligonucleotide
  modified_base (20)..(21): 2'-methoxy-nucleotide
cuaguucuaccucaggcaguu

SEQ ID NO: 1433 - RNA, 21 nt, Artificial Sequence
  Description of Artificial Sequence: Synthetic oligonucleotide
  modified_base (20)..(21): 2'-methoxy-nucleotide
uaguucuaccucaggcagcuu

SEQ ID NO: 1434 - RNA, 21 nt, Artificial Sequence
  Description of Artificial Sequence: Synthetic oligonucleotide
  modified_base (20)..(21): 2'-methoxy-nucleotide
aguucuaccucaggcagcuuu

SEQ ID NO: 1435 - RNA, 21 nt, Artificial Sequence
  Description of Artificial Sequence: Synthetic oligonucleotide
  modified_base (20)..(21): 2'-methoxy-nucleotide
guucuaccucaggcagcucuu

SEQ ID NO: 1436 - RNA, 21 nt, Artificial Sequence
  Description of Artificial Sequence: Synthetic oligonucleotide
  modified_base (20)..(21): 2'-methoxy-nucleotide
uucuaccucaggcagcucauu

SEQ ID NO: 1437 - RNA, 21 nt, Artificial Sequence
  Description of Artificial Sequence: Synthetic oligonucleotide
  modified_base (20)..(21): 2'-methoxy-nucleotide
ucuaccucaggcagcucaauu

SEQ ID NO: 1438 - RNA, 21 nt, Artificial Sequence
  Description of Artificial Sequence: Synthetic oligonucleotide
  modified_base (20)..(21): 2'-methoxy-nucleotide
cuaccucaggcagcucaaguu

SEQ ID NO: 1439 - RNA, 21 nt, Artificial Sequence
  Description of Artificial Sequence: Synthetic oligonucleotide
  modified_base (20)..(21): 2'-methoxy-nucleotide
uaccucaggcagcucaagcuu

SEQ ID NO: 1440 - RNA, 21 nt, Artificial Sequence
  Description of Artificial Sequence: Synthetic oligonucleotide
  modified_base (20)..(21): 2'-methoxy-nucleotide
accucaggcagcucaagcauu

SEQ ID NO: 1441 - RNA, 21 nt, Artificial Sequence
  Description of Artificial Sequence: Synthetic oligonucleotide
  modified_base (20)..(21): 2'-methoxy-nucleotide
ccucaggcagcucaagcaguu

SEQ ID NO: 1442 - RNA, 21 nt, Artificial Sequence
  Description of Artificial Sequence: Synthetic oligonucleotide
  modified_base (20)..(21): 2'-methoxy-nucleotide
cucaggcagcucaagcagcuu

SEQ ID NO: 1443 - RNA, 21 nt, Artificial Sequence
  Description of Artificial Sequence: Synthetic oligonucleotide
  modified_base (20)..(21): 2'-methoxy-nucleotide
ucaggcagcucaagcagcguu

SEQ ID NO: 1444 - RNA, 21 nt, Artificial Sequence
  Description of Artificial Sequence: Synthetic oligonucleotide
  modified_base (20)..(21): 2'-methoxy-nucleotide
caggcagcucaagcagcgauu

SEQ ID NO: 1445 - RNA, 21 nt, Artificial Sequence
  Description of Artificial Sequence: Synthetic oligonucleotide
  modified_base (20)..(21): 2'-methoxy-nucleotide
aggcagcucaagcagcgacuu

SEQ ID NO: 1446 - RNA, 21 nt, Artificial Sequence
  Description of Artificial Sequence: Synthetic oligonucleotide
  modified_base (20)..(21): 2'-methoxy-nucleotide
ggcagcucaagcagcgaccuu

SEQ ID NO: 1447 - RNA, 21 nt, Artificial Sequence
  Description of Artificial Sequence: Synthetic oligonucleotide
  modified_base (20)..(21): 2'-methoxy-nucleotide
gcagcucaagcagcgaccguu

SEQ ID NO: 1448 - RNA, 21 nt, Artificial Sequence
  Description of Artificial Sequence: Synthetic oligonucleotide
  modified_base (20)..(21): 2'-methoxy-nucleotide
cagcucaagcagcgaccgcuu

SEQ ID NO: 1449 - RNA, 21 nt, Artificial Sequence
  Description of Artificial Sequence: Synthetic oligonucleotide
  modified_base (20)..(21): 2'-methoxy-nucleotide
agcucaagcagcgaccgccuu

SEQ ID NO: 1450 - RNA, 21 nt, Artificial Sequence
  Description of Artificial Sequence: Synthetic oligonucleotide
  modified_base (20)..(21): 2'-methoxy-nucleotide
gcucaagcagcgaccgcccuu

SEQ ID NO: 1451 - RNA, 21 nt, Artificial Sequence
  Description of Artificial Sequence: Synthetic oligonucleotide
  modified_base (20)..(21): 2'-methoxy-nucleotide
cucaagcagcgaccgccccuu

SEQ ID NO: 1452 - RNA, 21 nt, Artificial Sequence
  Description of Artificial Sequence: Synthetic oligonucleotide
  modified_base (20)..(21): 2'-methoxy-nucleotide
ucaagcagcgaccgcccccuu

SEQ ID NO: 1453 - RNA, 21 nt, Artificial Sequence
  Description of Artificial Sequence: Synthetic oligonucleotide
  modified_base (20)..(21): 2'-methoxy-nucleotide
caagcagcgaccgcccccuuu

SEQ ID NO: 1454 - RNA, 21 nt, Artificial Sequence
  Description of Artificial Sequence: Synthetic oligonucleotide
  modified_base (20)..(21): 2'-methoxy-nucleotide
aagcagcgaccgcccccucuu

SEQ ID NO: 1455 - RNA, 21 nt, Artificial Sequence
  Description of Artificial Sequence: Synthetic oligonucleotide
  modified_base (20)..(21): 2'-methoxy-nucleotide
agcagcgaccgcccccuccuu

SEQ ID NO: 1456 - RNA, 21 nt, Artificial Sequence
  Description of Artificial Sequence: Synthetic oligonucleotide
  modified_base (20)..(21): 2'-methoxy-nucleotide
gcagcgaccgcccccuccuuu

SEQ ID NO: 1457 - RNA, 21 nt, Artificial Sequence
  Description of Artificial Sequence: Synthetic oligonucleotide
  modified_base (20)..(21): 2'-methoxy-nucleotide
cagcgaccgcccccuccucuu

SEQ ID NO: 1458 - RNA, 21 nt, Artificial Sequence
  Description of Artificial Sequence: Synthetic oligonucleotide
  modified_base (20)..(21): 2'-methoxy-nucleotide
agcgaccgcccccuccucuuu

SEQ ID NO: 1459 - RNA, 21 nt, Artificial Sequence
  Description of Artificial Sequence: Synthetic oligonucleotide
  modified_base (20)..(21): 2'-methoxy-nucleotide
gcgaccgcccccuccucuauu

SEQ ID NO: 1460 - RNA, 21 nt, Artificial Sequence
  Description of Artificial Sequence: Synthetic oligonucleotide
  modified_base (20)..(21): 2'-methoxy-nucleotide
cgaccgcccccuccucuaguu

SEQ ID NO: 1461 - RNA, 21 nt, Artificial Sequence
  Description of Artificial Sequence: Synthetic oligonucleotide
  modified_base (20)..(21): 2'-methoxy-nucleotide
gaccgcccccuccucuagcuu

SEQ ID NO: 1462 - RNA, 21 nt, Artificial Sequence
  Description of Artificial Sequence: Synthetic oligonucleotide
  modified_base (20)..(21): 2'-methoxy-nucleotide
accgcccccuccucuagcuuu

SEQ ID NO: 1463 - RNA, 21 nt, Artificial Sequence
  Description of Artificial Sequence: Synthetic oligonucleotide
  modified_base (20)..(21): 2'-methoxy-nucleotide
ccgcccccuccucuagcuguu

SEQ ID NO: 1464 - RNA, 21 nt, Artificial Sequence
  Description of Artificial Sequence: Synthetic oligonucleotide
  modified_base (20)..(21): 2'-methoxy-nucleotide
cgcccccuccucuagcuguuu

SEQ ID NO: 1465 - RNA, 21 nt, Artificial Sequence
  Description of Artificial Sequence: Synthetic oligonucleotide
  modified_base (20)..(21): 2'-methoxy-nucleotide
gcccccuccucuagcuguguu

SEQ ID NO: 1466 - RNA, 21 nt, Artificial Sequence
  Description of Artificial Sequence: Synthetic oligonucleotide
  modified_base (20)..(21): 2'-methoxy-nucleotide
cccccuccucuagcugugguu

SEQ ID NO: 1467 - RNA, 21 nt, Artificial Sequence
  Description of Artificial Sequence: Synthetic oligonucleotide
  modified_base (20)..(21): 2'-methoxy-nucleotide
ccccuccucuagcuguggguu

SEQ ID NO: 1468 - RNA, 21 nt, Artificial Sequence
  Description of Artificial Sequence: Synthetic oligonucleotide
  modified_base (20)..(21): 2'-methoxy-nucleotide
cccuccucuagcugugggguu

SEQ ID NO: 1469 - RNA, 21 nt, Artificial Sequence
  Description of Artificial Sequence: Synthetic oligonucleotide
  modified_base (20)..(21): 2'-methoxy-nucleotide
ccuccucuagcuguggggguu

SEQ ID NO: 1470 - RNA, 21 nt, Artificial Sequence
  Description of Artificial Sequence: Synthetic oligonucleotide
  modified_base (20)..(21): 2'-methoxy-nucleotide
cuccucuagcuguggggguuu

SEQ ID NO: 1471 - RNA, 21 nt, Artificial Sequence
  Description of Artificial Sequence: Synthetic oligonucleotide
  modified_base (20)..(21): 2'-methoxy-nucleotide
uccucuagcuguggggguguu

SEQ ID NO: 1472 - RNA, 21 nt, Artificial Sequence
  Description of Artificial Sequence: Synthetic oligonucleotide
  modified_base (20)..(21): 2'-methoxy-nucleotide
ccucuagcugugggggugauu

SEQ ID NO: 1473 - RNA, 21 nt, Artificial Sequence
  Description of Artificial Sequence: Synthetic oligonucleotide
  modified_base (20)..(21): 2'-methoxy-nucleotide
cucuagcugugggggugaguu

SEQ ID NO: 1474 - RNA, 21 nt, Artificial Sequence
  Description of Artificial Sequence: Synthetic oligonucleotide
  modified_base (20)..(21): 2'-methoxy-nucleotide
ucuagcugugggggugagguu

SEQ ID NO: 1475 - RNA, 21 nt, Artificial Sequence
  Description of Artificial Sequence: Synthetic oligonucleotide
  modified_base (20)..(21): 2'-methoxy-nucleotide
cuagcugugggggugaggguu

SEQ ID NO: 1476 - RNA, 21 nt, Artificial Sequence
  Description of Artificial Sequence: Synthetic oligonucleotide
  modified_base (20)..(21): 2'-methoxy-nucleotide
uagcugugggggugaggguuu

SEQ ID NO: 1477 - RNA, 21 nt, Artificial Sequence
  Description of Artificial Sequence: Synthetic oligonucleotide
  modified_base (20)..(21): 2'-methoxy-nucleotide
agcugugggggugagggucuu

SEQ ID NO: 1478 - RNA, 21 nt, Artificial Sequence
  Description of Artificial Sequence: Synthetic oligonucleotide
  modified_base (20)..(21): 2'-methoxy-nucleotide
gcugugggggugaggguccuu

SEQ ID NO: 1479 - RNA, 21 nt, Artificial Sequence
  Description of Artificial Sequence: Synthetic oligonucleotide
  modified_base (20)..(21): 2'-methoxy-nucleotide
cugugggggugagggucccuu

SEQ ID NO: 1480 - RNA, 21 nt, Artificial Sequence
  Description of Artificial Sequence: Synthetic oligonucleotide
  modified_base (20)..(21): 2'-methoxy-nucleotide
ugugggggugagggucccauu

SEQ ID NO: 1481 - RNA, 21 nt, Artificial Sequence
  Description of Artificial Sequence: Synthetic oligonucleotide
  modified_base (20)..(21): 2'-methoxy-nucleotide
gugggggugagggucccauuu

SEQ ID NO: 1482 - RNA, 21 nt, Artificial Sequence
  Description of Artificial Sequence: Synthetic oligonucleotide
  modified_base (20)..(21): 2'-methoxy-nucleotide
ugggggugagggucccauguu

SEQ ID NO: 1483 - RNA, 21 nt, Artificial Sequence
  Description of Artificial Sequence: Synthetic oligonucleotide
  modified_base (20)..(21): 2'-methoxy-nucleotide
gggggugagggucccauguuu

SEQ ID NO: 1484 - RNA, 21 nt, Artificial Sequence
  Description of Artificial Sequence: Synthetic oligonucleotide
  modified_base (20)..(21): 2'-methoxy-nucleotide
ggggugagggucccauguguu

SEQ ID NO: 1485 - RNA, 21 nt, Artificial Sequence
  Description of Artificial Sequence: Synthetic oligonucleotide
  modified_base (20)..(21): 2'-methoxy-nucleotide
gggugagggucccaugugguu

SEQ ID NO: 1486 - RNA, 21 nt, Artificial Sequence
  Description of Artificial Sequence: Synthetic oligonucleotide
  modified_base (20)..(21): 2'-methoxy-nucleotide
ggugagggucccaugugguuu

SEQ ID NO: 1487 - RNA, 21 nt, Artificial Sequence
  Description of Artificial Sequence: Synthetic oligonucleotide
  modified_base (20)..(21): 2'-methoxy-nucleotide
gugagggucccaugugguguu

SEQ ID NO: 1488 - RNA, 21 nt, Artificial Sequence
  Description of Artificial Sequence: Synthetic oligonucleotide
  modified_base (20)..(21): 2'-methoxy-nucleotide
ugagggucccauguggugguu

SEQ ID NO: 1489 - RNA, 21 nt, Artificial Sequence
  Description of Artificial Sequence: Synthetic oligonucleotide
  modified_base (20)..(21): 2'-methoxy-nucleotide
gagggucccaugugguggcuu

SEQ ID NO: 1490 - RNA, 21 nt, Artificial Sequence
  Description of Artificial Sequence: Synthetic oligonucleotide
  modified_base (20)..(21): 2'-methoxy-nucleotide
agggucccaugugguggcauu

SEQ ID NO: 1491 - RNA, 21 nt, Artificial Sequence
  Description of Artificial Sequence: Synthetic oligonucleotide
  modified_base (20)..(21): 2'-methoxy-nucleotide
gggucccaugugguggcacuu

SEQ ID NO: 1492 - RNA, 21 nt, Artificial Sequence
  Description of Artificial Sequence: Synthetic oligonucleotide
  modified_base (20)..(21): 2'-methoxy-nucleotide
ggucccaugugguggcacauu

SEQ ID NO: 1493 - RNA, 21 nt, Artificial Sequence
  Description of Artificial Sequence: Synthetic oligonucleotide
  modified_base (20)..(21): 2'-methoxy-nucleotide
gucccaugugguggcacaguu

SEQ ID NO: 1494 - RNA, 21 nt, Artificial Sequence
  Description of Artificial Sequence: Synthetic oligonucleotide
  modified_base (20)..(21): 2'-methoxy-nucleotide
ucccaugugguggcacagguu

SEQ ID NO: 1495 - RNA, 21 nt, Artificial Sequence
  Description of Artificial Sequence: Synthetic oligonucleotide
  modified_base (20)..(21): 2'-methoxy-nucleotide
cccaugugguggcacaggcuu

SEQ ID NO: 1496 - RNA, 21 nt, Artificial Sequence
  Description of Artificial Sequence: Synthetic oligonucleotide
  modified_base (20)..(21): 2'-methoxy-nucleotide
ccaugugguggcacaggccuu

SEQ ID NO: 1497 - RNA, 21 nt, Artificial Sequence
  Description of Artificial Sequence: Synthetic oligonucleotide
  modified_base (20)..(21): 2'-methoxy-nucleotide
caugugguggcacaggcccuu

SEQ ID NO: 1498 - RNA, 21 nt, Artificial Sequence
  Description of Artificial Sequence: Synthetic oligonucleotide
  modified_base (20)..(21): 2'-methoxy-nucleotide
augugguggcacaggccccuu

SEQ ID NO: 1499 - RNA, 21 nt, Artificial Sequence
  Description of Artificial Sequence: Synthetic oligonucleotide
  modified_base (20)..(21): 2'-methoxy-nucleotide
ugugguggcacaggcccccuu

SEQ ID NO: 1500 - RNA, 21 nt, Artificial Sequence
  Description of Artificial Sequence: Synthetic oligonucleotide
  modified_base (20)..(21): 2'-methoxy-nucleotide
gugguggcacaggcccccuuu

SEQ ID NO: 1501 - RNA, 21 nt, Artificial Sequence
  Description of Artificial Sequence: Synthetic oligonucleotide
  modified_base (20)..(21): 2'-methoxy-nucleotide
ugguggcacaggcccccuuuu

SEQ ID NO: 1502 - RNA, 21 nt, Artificial Sequence
  Description of Artificial Sequence: Synthetic oligonucleotide
  modified_base (20)..(21): 2'-methoxy-nucleotide
gguggcacaggcccccuuguu

SEQ ID NO: 1503 - RNA, 21 nt, Artificial Sequence
  Description of Artificial Sequence: Synthetic oligonucleotide
  modified_base (20)..(21): 2'-methoxy-nucleotide
guggcacaggcccccuugauu

SEQ ID NO: 1504 - RNA, 21 nt, Artificial Sequence
  Description of Artificial Sequence: Synthetic oligonucleotide
  modified_base (20)..(21): 2'-methoxy-nucleotide
uggcacaggcccccuugaguu

SEQ ID NO: 1505 - RNA, 21 nt, Artificial Sequence
  Description of Artificial Sequence: Synthetic oligonucleotide
  modified_base (20)..(21): 2'-methoxy-nucleotide
ggcacaggcccccuugaguuu

SEQ ID NO: 1506 - RNA, 21 nt, Artificial Sequence
  Description of Artificial Sequence: Synthetic oligonucleotide
  modified_base (20)..(21): 2'-methoxy-nucleotide
gcacaggcccccuugaguguu

SEQ ID NO: 1507 - RNA, 21 nt, Artificial Sequence
  Description of Artificial Sequence: Synthetic oligonucleotide
  modified_base (20)..(21): 2'-methoxy-nucleotide
cacaggcccccuugagugguu

SEQ ID NO: 1508 - RNA, 21 nt, Artificial Sequence
  Description of Artificial Sequence: Synthetic oligonucleotide
  modified_base (20)..(21): 2'-methoxy-nucleotide
acaggcccccuugaguggguu

SEQ ID NO: 1509 - RNA, 21 nt, Artificial Sequence
  Description of Artificial Sequence: Synthetic oligonucleotide
  modified_base (20)..(21): 2'-methoxy-nucleotide
caggcccccuugagugggguu

SEQ ID NO: 1510 - RNA, 21 nt, Artificial Sequence
  Description of Artificial Sequence: Synthetic oligonucleotide
  modified_base (20)..(21): 2'-methoxy-nucleotide
aggcccccuugagugggguuu

SEQ ID NO: 1511 - RNA, 21 nt, Artificial Sequence
  Description of Artificial Sequence: Synthetic oligonucleotide
  modified_base (20)..(21): 2'-methoxy-nucleotide
ggcccccuugagugggguuuu

SEQ ID NO: 1512 - RNA, 21 nt, Artificial Sequence
  Description of Artificial Sequence: Synthetic oligonucleotide
  modified_base (20)..(21): 2'-methoxy-nucleotide
gcccccuugagugggguuauu

SEQ ID NO: 1513 - RNA, 21 nt, Artificial Sequence
  Description of Artificial Sequence: Synthetic oligonucleotide
  modified_base (20)..(21): 2'-methoxy-nucleotide
cccccuugagugggguuauuu

SEQ ID NO: 1514 - RNA, 21 nt, Artificial Sequence
  Description of Artificial Sequence: Synthetic oligonucleotide
  modified_base (20)..(21): 2'-methoxy-nucleotide
ccccuugagugggguuaucuu

SEQ ID NO: 1515 - RNA, 21 nt, Artificial Sequence
  Description of Artificial Sequence: Synthetic oligonucleotide
  modified_base (20)..(21): 2'-methoxy-nucleotide
cccuugagugggguuaucuuu

SEQ ID NO: 1516 - RNA, 21 nt, Artificial Sequence
  Description of Artificial Sequence: Synthetic oligonucleotide
  modified_base (20)..(21): 2'-methoxy-nucleotide
ccuugagugggguuaucucuu

SEQ ID NO: 1517 - RNA, 21 nt, Artificial Sequence
  Description of Artificial Sequence: Synthetic oligonucleotide
  modified_base (20)..(21): 2'-methoxy-nucleotide
cuugagugggguuaucucuuu

SEQ ID NO: 1518 - RNA, 21 nt, Artificial Sequence
  Description of Artificial Sequence: Synthetic oligonucleotide
  modified_base (20)..(21): 2'-methoxy-nucleotide
uugagugggguuaucucuguu

SEQ ID NO: 1519 - RNA, 21 nt, Artificial Sequence
  Description of Artificial Sequence: Synthetic oligonucleotide
  modified_base (20)..(21): 2'-methoxy-nucleotide
ugagugggguuaucucuguuu

SEQ ID NO: 1520 - RNA, 21 nt, Artificial Sequence
  Description of Artificial Sequence: Synthetic oligonucleotide
  modified_base (20)..(21): 2'-methoxy-nucleotide
gagugggguuaucucuguguu

SEQ ID NO: 1521 - RNA, 21 nt, Artificial Sequence
  Description of Artificial Sequence: Synthetic oligonucleotide
  modified_base (20)..(21): 2'-methoxy-nucleotide
agugggguuaucucuguguuu

SEQ ID NO: 1522 - RNA, 21 nt, Artificial Sequence
  Description of Artificial Sequence: Synthetic oligonucleotide
  modified_base (20)..(21): 2'-methoxy-nucleotide
gugggguuaucucuguguuuu

SEQ ID NO: 1523 - RNA, 21 nt, Artificial Sequence
  Description of Artificial Sequence: Synthetic oligonucleotide
  modified_base (20)..(21): 2'-methoxy-nucleotide
ugggguuaucucuguguuauu

SEQ ID NO: 1524 - RNA, 21 nt, Artificial Sequence
  Description of Artificial Sequence: Synthetic oligonucleotide
  modified_base (20)..(21): 2'-methoxy-nucleotide
gggguuaucucuguguuaguu

SEQ ID NO: 1525 - RNA, 21 nt, Artificial Sequence
  Description of Artificial Sequence: Synthetic oligonucleotide
  modified_base (20)..(21): 2'-methoxy-nucleotide
ggguuaucucuguguuagguu

SEQ ID NO: 1526 - RNA, 21 nt, Artificial Sequence
  Description of Artificial Sequence: Synthetic oligonucleotide
  modified_base (20)..(21): 2'-methoxy-nucleotide
gguuaucucuguguuaggguu

SEQ ID NO: 1527 - RNA, 21 nt, Artificial Sequence
  Description of Artificial Sequence: Synthetic oligonucleotide
  modified_base (20)..(21): 2'-methoxy-nucleotide
guuaucucuguguuagggguu

SEQ ID NO: 1528 - RNA, 21 nt, Artificial Sequence
  Description of Artificial Sequence: Synthetic oligonucleotide
  modified_base (20)..(21): 2'-methoxy-nucleotide
uuaucucuguguuagggguuu

SEQ ID NO: 1529 - RNA, 21 nt, Artificial Sequence
  Description of Artificial Sequence: Synthetic oligonucleotide
  modified_base (20)..(21): 2'-methoxy-nucleotide
uaucucuguguuagggguauu

SEQ ID NO: 1530 - RNA, 21 nt, Artificial Sequence
  Description of Artificial Sequence: Synthetic oligonucleotide
  modified_base (20)..(21): 2'-methoxy-nucleotide
aucucuguguuagggguauuu

SEQ ID NO: 1531 - RNA, 21 nt, Artificial Sequence
  Description of Artificial Sequence: Synthetic oligonucleotide
  modified_base (20)..(21): 2'-methoxy-nucleotide
ucucuguguuagggguauauu

SEQ ID NO: 1532 - RNA, 21 nt, Artificial Sequence
  Description of Artificial Sequence: Synthetic oligonucleotide
  modified_base (20)..(21): 2'-methoxy-nucleotide
cucuguguuagggguauauuu

SEQ ID NO: 1533 - RNA, 21 nt, Artificial Sequence
  Description of Artificial Sequence: Synthetic oligonucleotide
  modified_base (20)..(21): 2'-methoxy-nucleotide
ucuguguuagggguauauguu

SEQ ID NO: 1534 - RNA, 21 nt, Artificial Sequence
  Description of Artificial Sequence: Synthetic oligonucleotide
  modified_base (20)..(21): 2'-methoxy-nucleotide
cuguguuagggguauaugauu

SEQ ID NO: 1535 - RNA, 21 nt, Artificial Sequence
  Description of Artificial Sequence: Synthetic oligonucleotide
  modified_base (20)..(21): 2'-methoxy-nucleotide
uguguuagggguauaugauuu

SEQ ID NO: 1536 - RNA, 21 nt, Artificial Sequence
  Description of Artificial Sequence: Synthetic oligonucleotide
  modified_base (20)..(21): 2'-methoxy-nucleotide
guguuagggguauaugauguu

SEQ ID NO: 1537 - RNA, 21 nt, Artificial Sequence
  Description of Artificial Sequence: Synthetic oligonucleotide
  modified_base (20)..(21): 2'-methoxy-nucleotide
uguuagggguauaugaugguu

SEQ ID NO: 1538 - RNA, 21 nt, Artificial Sequence
  Description of Artificial Sequence: Synthetic oligonucleotide
  modified_base (20)..(21): 2'-methoxy-nucleotide
guuagggguauaugauggguu

SEQ ID NO: 1539 - RNA, 21 nt, Artificial Sequence
  Description of Artificial Sequence: Synthetic oligonucleotide
  modified_base (20)..(21): 2'-methoxy-nucleotide
uuagggguauaugaugggguu

SEQ ID NO: 1540 - RNA, 21 nt, Artificial Sequence
  Description of Artificial Sequence: Synthetic oligonucleotide
  modified_base (20)..(21): 2'-methoxy-nucleotide
uagggguauaugauggggguu

SEQ ID NO: 1541 - RNA, 21 nt, Artificial Sequence
  Description of Artificial Sequence: Synthetic oligonucleotide
  modified_base (20)..(21): 2'-methoxy-nucleotide
agggguauaugaugggggauu

SEQ ID NO: 1542 - RNA, 21 nt, Artificial Sequence
  Description of Artificial Sequence: Synthetic oligonucleotide
  modified_base (20)..(21): 2'-methoxy-nucleotide
gggguauaugaugggggaguu

SEQ ID NO: 1543 - RNA, 21 nt, Artificial Sequence
  Description of Artificial Sequence: Synthetic oligonucleotide
  modified_base (20)..(21): 2'-methoxy-nucleotide
ggguauaugaugggggaguuu

SEQ ID NO: 1544 - RNA, 21 nt, Artificial Sequence
  Description of Artificial Sequence: Synthetic oligonucleotide
  modified_base (20)..(21): 2'-methoxy-nucleotide
gguauaugaugggggaguauu

SEQ ID NO: 1545 - RNA, 21 nt, Artificial Sequence
  Description of Artificial Sequence: Synthetic oligonucleotide
  modified_base (20)..(21): 2'-methoxy-nucleotide
guauaugaugggggaguaguu

SEQ ID NO: 1546 - RNA, 21 nt, Artificial Sequence
  Description of Artificial Sequence: Synthetic oligonucleotide
  modified_base (20)..(21): 2'-methoxy-nucleotide
uauaugaugggggaguagauu

SEQ ID NO: 1547 - RNA, 21 nt, Artificial Sequence
  Description of Artificial Sequence: Synthetic oligonucleotide
  modified_base (20)..(21): 2'-methoxy-nucleotide
auaugaugggggaguagauuu

SEQ ID NO: 1548 - RNA, 21 nt, Artificial Sequence
  Description of Artificial Sequence: Synthetic oligonucleotide
  modified_base (20)..(21): 2'-methoxy-nucleotide
uaugaugggggaguagaucuu

SEQ ID NO: 1549 - RNA, 21 nt, Artificial Sequence
  Description of Artificial Sequence: Synthetic oligonucleotide
  modified_base (20)..(21): 2'-methoxy-nucleotide
augaugggggaguagaucuuu

SEQ ID NO: 1550 - RNA, 21 nt, Artificial Sequence
  Description of Artificial Sequence: Synthetic oligonucleotide
  modified_base (20)..(21): 2'-methoxy-nucleotide
ugaugggggaguagaucuuuu

SEQ ID NO: 1551 - RNA, 21 nt, Artificial Sequence
  Description of Artificial Sequence: Synthetic oligonucleotide
  modified_base (20)..(21): 2'-methoxy-nucleotide
gaugggggaguagaucuuuuu

SEQ ID NO: 1552 - RNA, 21 nt, Artificial Sequence
  Description of Artificial Sequence: Synthetic oligonucleotide
  modified_base (20)..(21): 2'-methoxy-nucleotide
augggggaguagaucuuucuu

SEQ ID NO: 1553 - RNA, 21 nt, Artificial Sequence
  Description of Artificial Sequence: Synthetic oligonucleotide
  modified_base (20)..(21): 2'-methoxy-nucleotide
ugggggaguagaucuuucuuu

SEQ ID NO: 1554 - RNA, 21 nt, Artificial Sequence
  Description of Artificial Sequence: Synthetic oligonucleotide
  modified_base (20)..(21): 2'-methoxy-nucleotide
gggggaguagaucuuucuauu

SEQ ID NO: 1555 - RNA, 21 nt, Artificial Sequence
  Description of Artificial Sequence: Synthetic oligonucleotide
  modified_base (20)..(21): 2'-methoxy-nucleotide
ggggaguagaucuuucuaguu

SEQ ID NO: 1556 - RNA, 21 nt, Artificial Sequence
  Description of Artificial Sequence: Synthetic oligonucleotide
  modified_base (20)..(21): 2'-methoxy-nucleotide
gggaguagaucuuucuagguu

SEQ ID NO: 1557 - RNA, 21 nt, Artificial Sequence
  Description of Artificial Sequence: Synthetic oligonucleotide
  modified_base (20)..(21): 2'-methoxy-nucleotide
ggaguagaucuuucuaggauu

SEQ ID NO: 1558 - RNA, 21 nt, Artificial Sequence
  Description of Artificial Sequence: Synthetic oligonucleotide
  modified_base (20)..(21): 2'-methoxy-nucleotide
gaguagaucuuucuaggaguu

SEQ ID NO: 1559 - RNA, 21 nt, Artificial Sequence
  Description of Artificial Sequence: Synthetic oligonucleotide
  modified_base (20)..(21): 2'-methoxy-nucleotide
aguagaucuuucuaggagguu

SEQ ID NO: 1560 - RNA, 21 nt, Artificial Sequence
  Description of Artificial Sequence: Synthetic oligonucleotide
  modified_base (20)..(21): 2'-methoxy-nucleotide
guagaucuuucuaggaggguu

SEQ ID NO: 1561 - RNA, 21 nt, Artificial Sequence
  Description of Artificial Sequence: Synthetic oligonucleotide
  modified_base (20)..(21): 2'-methoxy-nucleotide
uagaucuuucuaggagggauu

SEQ ID NO: 1562 - RNA, 21 nt, Artificial Sequence
  Description of Artificial Sequence: Synthetic oligonucleotide
  modified_base (20)..(21): 2'-methoxy-nucleotide
agaucuuucuaggagggaguu

SEQ ID NO: 1563 - RNA, 21 nt, Artificial Sequence
  Description of Artificial Sequence: Synthetic oligonucleotide
  modified_base (20)..(21): 2'-methoxy-nucleotide
gaucuuucuaggagggagauu

SEQ ID NO: 1564 - RNA, 21 nt, Artificial Sequence
  Description of Artificial Sequence: Synthetic oligonucleotide
  modified_base (20)..(21): 2'-methoxy-nucleotide
aucuuucuaggagggagacuu

SEQ ID NO: 1565 - RNA, 21 nt, Artificial Sequence
  Description of Artificial Sequence: Synthetic oligonucleotide
  modified_base (20)..(21): 2'-methoxy-nucleotide
ucuuucuaggagggagacauu

SEQ ID NO: 1566 - RNA, 21 nt, Artificial Sequence
  Description of Artificial Sequence: Synthetic oligonucleotide
  modified_base (20)..(21): 2'-methoxy-nucleotide
cuuucuaggagggagacacuu

SEQ ID NO: 1567 - RNA, 21 nt, Artificial Sequence
  Description of Artificial Sequence: Synthetic oligonucleotide
  modified_base (20)..(21): 2'-methoxy-nucleotide
uuucuaggagggagacacuuu

SEQ ID NO: 1568 - RNA, 21 nt, Artificial Sequence
  Description of Artificial Sequence: Synthetic oligonucleotide
  modified_base (20)..(21): 2'-methoxy-nucleotide
uucuaggagggagacacuguu

SEQ ID NO: 1569 - RNA, 21 nt, Artificial Sequence
  Description of Artificial Sequence: Synthetic oligonucleotide
  modified_base (20)..(21): 2'-methoxy-nucleotide
ucuaggagggagacacugguu

SEQ ID NO: 1570 - RNA, 21 nt, Artificial Sequence
  Description of Artificial Sequence: Synthetic oligonucleotide
  modified_base (20)..(21): 2'-methoxy-nucleotide
cuaggagggagacacuggcuu

SEQ ID NO: 1571 - RNA, 21 nt, Artificial Sequence
  Description of Artificial Sequence: Synthetic oligonucleotide
  modified_base (20)..(21): 2'-methoxy-nucleotide
uaggagggagacacuggccuu

SEQ ID NO: 1572 - RNA, 21 nt, Artificial Sequence
  Description of Artificial Sequence: Synthetic oligonucleotide
  modified_base (20)..(21): 2'-methoxy-nucleotide
aggagggagacacuggcccuu

SEQ ID NO: 1573 - RNA, 21 nt, Artificial Sequence
  Description of Artificial Sequence: Synthetic oligonucleotide
  modified_base (20)..(21): 2'-methoxy-nucleotide
ggagggagacacuggccccuu

SEQ ID NO: 1574 - RNA, 21 nt, Artificial Sequence
  Description of Artificial Sequence: Synthetic oligonucleotide
  modified_base (20)..(21): 2'-methoxy-nucleotide
gagggagacacuggccccuuu

SEQ ID NO: 1575 - RNA, 21 nt, Artificial Sequence
  Description of Artificial Sequence: Synthetic oligonucleotide
  modified_base (20)..(21): 2'-methoxy-nucleotide
agggagacacuggccccucuu

SEQ ID NO: 1576 - RNA, 21 nt, Artificial Sequence
  Description of Artificial Sequence: Synthetic oligonucleotide
  modified_base (20)..(21): 2'-methoxy-nucleotide
gggagacacuggccccucauu

SEQ ID NO: 1577 - RNA, 21 nt, Artificial Sequence
  Description of Artificial Sequence: Synthetic oligonucleotide
  modified_base (20)..(21): 2'-methoxy-nucleotide
ggagacacuggccccucaauu

SEQ ID NO: 1578 - RNA, 21 nt, Artificial Sequence
  Description of Artificial Sequence: Synthetic oligonucleotide
  modified_base (20)..(21): 2'-methoxy-nucleotide
gagacacuggccccucaaauu

SEQ ID NO: 1579 - RNA, 21 nt, Artificial Sequence
  Description of Artificial Sequence: Synthetic oligonucleotide
  modified_base (20)..(21): 2'-methoxy-nucleotide
agacacuggccccucaaauuu

SEQ ID NO: 1580 - RNA, 21 nt, Artificial Sequence
  Description of Artificial Sequence: Synthetic oligonucleotide
  modified_base (20)..(21): 2'-methoxy-nucleotide
gacacuggccccucaaaucuu

SEQ ID NO: 1581 - RNA, 21 nt, Artificial Sequence
  Description of Artificial Sequence: Synthetic oligonucleotide
  modified_base (20)..(21): 2'-methoxy-nucleotide
acacuggccccucaaaucguu

SEQ ID NO: 1582 - RNA, 21 nt, Artificial Sequence
  Description of Artificial Sequence: Synthetic oligonucleotide
  modified_base (20)..(21): 2'-methoxy-nucleotide
cacuggccccucaaaucguuu

SEQ ID NO: 1583 - RNA, 21 nt, Artificial Sequence
  Description of Artificial Sequence: Synthetic oligonucleotide
  modified_base (20)..(21): 2'-methoxy-nucleotide
acuggccccucaaaucgucuu

SEQ ID NO: 1584 - RNA, 21 nt, Artificial Sequence
  Description of Artificial Sequence: Synthetic oligonucleotide
  modified_base (20)..(21): 2'-methoxy-nucleotide
cuggccccucaaaucguccuu

SEQ ID NO: 1585 - RNA, 21 nt, Artificial Sequence
  Description of Artificial Sequence: Synthetic oligonucleotide
  modified_base (20)..(21): 2'-methoxy-nucleotide
uggccccucaaaucguccauu

SEQ ID NO: 1586 - RNA, 21 nt, Artificial Sequence
  Description of Artificial Sequence: Synthetic oligonucleotide
  modified_base (20)..(21): 2'-methoxy-nucleotide
ggccccucaaaucguccaguu

SEQ ID NO: 1587 - RNA, 21 nt, Artificial Sequence
  Description of Artificial Sequence: Synthetic oligonucleotide
  modified_base (20)..(21): 2'-methoxy-nucleotide
gccccucaaaucguccagcuu

SEQ ID NO: 1588 - RNA, 21 nt, Artificial Sequence
  Description of Artificial Sequence: Synthetic oligonucleotide
  modified_base (20)..(21): 2'-methoxy-nucleotide
ccccucaaaucguccagcguu

SEQ ID NO: 1589 - RNA, 21 nt, Artificial Sequence
  Description of Artificial Sequence: Synthetic oligonucleotide
  modified_base (20)..(21): 2'-methoxy-nucleotide
cccucaaaucguccagcgauu

SEQ ID NO: 1590 - RNA, 21 nt, Artificial Sequence
  Description of Artificial Sequence: Synthetic oligonucleotide
  modified_base (20)..(21): 2'-methoxy-nucleotide
ccucaaaucguccagcgacuu

SEQ ID NO: 1591 - RNA, 21 nt, Artificial Sequence
  Description of Artificial Sequence: Synthetic oligonucleotide
  modified_base (20)..(21): 2'-methoxy-nucleotide
cucaaaucguccagcgaccuu

SEQ ID NO: 1592 - RNA, 21 nt, Artificial Sequence
  Description of Artificial Sequence: Synthetic oligonucleotide
  modified_base (20)..(21): 2'-methoxy-nucleotide
ucaaaucguccagcgaccuuu

SEQ ID NO: 1593 - RNA, 21 nt, Artificial Sequence
  Description of Artificial Sequence: Synthetic oligonucleotide
  modified_base (20)..(21): 2'-methoxy-nucleotide
caaaucguccagcgaccuuuu

SEQ ID NO: 1594 - RNA, 21 nt, Artificial Sequence
  Description of Artificial Sequence: Synthetic oligonucleotide
  modified_base (20)..(21): 2'-methoxy-nucleotide
aaaucguccagcgaccuucuu

SEQ ID NO: 1595 - RNA, 21 nt, Artificial Sequence
  Description of Artificial Sequence: Synthetic oligonucleotide
  modified_base (20)..(21): 2'-methoxy-nucleotide
aaucguccagcgaccuuccuu

SEQ ID NO: 1596 - RNA, 21 nt, Artificial Sequence
  Description of Artificial Sequence: Synthetic oligonucleotide
  modified_base (20)..(21): 2'-methoxy-nucleotide
aucguccagcgaccuuccuuu

SEQ ID NO: 1597 - RNA, 21 nt, Artificial Sequence
  Description of Artificial Sequence: Synthetic oligonucleotide
  modified_base (20)..(21): 2'-methoxy-nucleotide
ucguccagcgaccuuccucuu

SEQ ID NO: 1598 - RNA, 21 nt, Artificial Sequence
  Description of Artificial Sequence: Synthetic oligonucleotide
  modified_base (20)..(21): 2'-methoxy-nucleotide
cguccagcgaccuuccucauu

SEQ ID NO: 1599 - RNA, 21 nt, Artificial Sequence
  Description of Artificial Sequence: Synthetic oligonucleotide
  modified_base (20)..(21): 2'-methoxy-nucleotide
guccagcgaccuuccucauuu

SEQ ID NO: 1600 - RNA, 21 nt, Artificial Sequence
  Description of Artificial Sequence: Synthetic oligonucleotide
  modified_base (20)..(21): 2'-methoxy-nucleotide
uccagcgaccuuccucaucuu

SEQ ID NO: 1601 - RNA, 21 nt, Artificial Sequence
  Description of Artificial Sequence: Synthetic oligonucleotide
  modified_base (20)..(21): 2'-methoxy-nucleotide
ccagcgaccuuccucauccuu

SEQ ID NO: 1602 - RNA, 21 nt, Artificial Sequence
  Description of Artificial Sequence: Synthetic oligonucleotide
  modified_base (20)..(21): 2'-methoxy-nucleotide
cagcgaccuuccucauccauu

SEQ ID NO: 1603 - RNA, 21 nt, Artificial Sequence
  Description of Artificial Sequence: Synthetic oligonucleotide
  modified_base (20)..(21): 2'-methoxy-nucleotide
agcgaccuuccucauccacuu

SEQ ID NO: 1604 - RNA, 21 nt, Artificial Sequence
  Description of Artificial Sequence: Synthetic oligonucleotide
  modified_base (20)..(21): 2'-methoxy-nucleotide
gcgaccuuccucauccaccuu

SEQ ID NO: 1605 - RNA, 21 nt, Artificial Sequence
  Description of Artificial Sequence: Synthetic oligonucleotide
  modified_base (20)..(21): 2'-methoxy-nucleotide
cgaccuuccucauccacccuu

SEQ ID NO: 1606 - RNA, 21 nt, Artificial Sequence
  Description of Artificial Sequence: Synthetic oligonucleotide
  modified_base (20)..(21): 2'-methoxy-nucleotide
gaccuuccucauccaccccuu

SEQ ID NO: 1607 - RNA, 21 nt, Artificial Sequence
  Description of Artificial Sequence: Synthetic oligonucleotide
  modified_base (20)..(21): 2'-methoxy-nucleotide
accuuccucauccaccccauu

SEQ ID NO: 1608 - RNA, 21 nt, Artificial Sequence
  Description of Artificial Sequence: Synthetic oligonucleotide
  modified_base (20)..(21): 2'-methoxy-nucleotide
ccuuccucauccaccccauuu

SEQ ID NO: 1609 - RNA, 21 nt, Artificial Sequence
  Description of Artificial Sequence: Synthetic oligonucleotide
  modified_base (20)..(21): 2'-methoxy-nucleotide
cuuccucauccaccccaucuu

SEQ ID NO: 1610 - RNA, 21 nt, Artificial Sequence
  Description of Artificial Sequence: Synthetic oligonucleotide
  modified_base (20)..(21): 2'-methoxy-nucleotide
uuccucauccaccccauccuu

SEQ ID NO: 1611 - RNA, 21 nt, Artificial Sequence
  Description of Artificial Sequence: Synthetic oligonucleotide
  modified_base (20)..(21): 2'-methoxy-nucleotide
uccucauccaccccaucccuu

SEQ ID NO: 1612 - RNA, 21 nt, Artificial Sequence
  Description of Artificial Sequence: Synthetic oligonucleotide
  modified_base (20)..(21): 2'-methoxy-nucleotide
ccucauccaccccaucccuuu

SEQ ID NO: 1613 - RNA, 21 nt, Artificial Sequence
  Description of Artificial Sequence: Synthetic oligonucleotide
  modified_base (20)..(21): 2'-methoxy-nucleotide
cucauccaccccaucccucuu

SEQ ID NO: 1614 - RNA, 21 nt, Artificial Sequence
  Description of Artificial Sequence: Synthetic oligonucleotide
  modified_base (20)..(21): 2'-methoxy-nucleotide
ucauccaccccaucccuccuu

SEQ ID NO: 1615 - RNA, 21 nt, Artificial Sequence
  Description of Artificial Sequence: Synthetic oligonucleotide
  modified_base (20)..(21): 2'-methoxy-nucleotide
cauccaccccaucccucccuu

SEQ ID NO: 1616 - RNA, 21 nt, Artificial Sequence
  Description of Artificial Sequence: Synthetic oligonucleotide
  modified_base (20)..(21): 2'-methoxy-nucleotide
auccaccccaucccuccccuu

SEQ ID NO: 1617 - RNA, 21 nt, Artificial Sequence
  Description of Artificial Sequence: Synthetic oligonucleotide
  modified_base (20)..(21): 2'-methoxy-nucleotide
uccaccccaucccuccccauu

SEQ ID NO: 1618 - RNA, 21 nt, Artificial Sequence
  Description of Artificial Sequence: Synthetic oligonucleotide
  modified_base (20)..(21): 2'-methoxy-nucleotide
ccaccccaucccuccccaguu

SEQ ID NO: 1619 - RNA, 21 nt, Artificial Sequence
  Description of Artificial Sequence: Synthetic oligonucleotide
  modified_base (20)..(21): 2'-methoxy-nucleotide
caccccaucccuccccaguuu

SEQ ID NO: 1620 - RNA, 21 nt, Artificial Sequence
  Description of Artificial Sequence: Synthetic oligonucleotide
  modified_base (20)..(21): 2'-methoxy-nucleotide
accccaucccuccccaguuuu

SEQ ID NO: 1621 - RNA, 21 nt, Artificial Sequence
  Description of Artificial Sequence: Synthetic oligonucleotide
  modified_base (20)..(21): 2'-methoxy-nucleotide
ccccaucccuccccaguucuu

SEQ ID NO: 1622 - RNA, 21 nt, Artificial Sequence
  Description of Artificial Sequence: Synthetic oligonucleotide
  modified_base (20)..(21): 2'-methoxy-nucleotide
cccaucccuccccaguucauu

SEQ ID NO: 1623 - RNA, 21 nt, Artificial Sequence
  Description of Artificial Sequence: Synthetic oligonucleotide
  modified_base (20)..(21): 2'-methoxy-nucleotide
ccaucccuccccaguucauuu

SEQ ID NO: 1624 - RNA, 21 nt, Artificial Sequence
  Description of Artificial Sequence: Synthetic oligonucleotide
  modified_base (20)..(21): 2'-methoxy-nucleotide
caucccuccccaguucauuuu

SEQ ID NO: 1625 - RNA, 21 nt, Artificial Sequence
  Description of Artificial Sequence: Synthetic oligonucleotide
  modified_base (20)..(21): 2'-methoxy-nucleotide
aucccuccccaguucauuguu

SEQ ID NO: 1626 - RNA, 21 nt, Artificial Sequence
  Description of Artificial Sequence: Synthetic oligonucleotide
  modified_base (20)..(21): 2'-methoxy-nucleotide
ucccuccccaguucauugcuu

SEQ ID NO: 1627 - RNA, 21 nt, Artificial Sequence
  Description of Artificial Sequence: Synthetic oligonucleotide
  modified_base (20)..(21): 2'-methoxy-nucleotide
cccuccccaguucauugcauu

SEQ ID NO: 1628 - RNA, 21 nt, Artificial Sequence
  Description of Artificial Sequence: Synthetic oligonucleotide
  modified_base (20)..(21): 2'-methoxy-nucleotide
ccuccccaguucauugcacuu

SEQ ID NO: 1629 - RNA, 21 nt, Artificial Sequence
  Description of Artificial Sequence: Synthetic oligonucleotide
  modified_base (20)..(21): 2'-methoxy-nucleotide
cuccccaguucauugcacuuu

SEQ ID NO: 1630 - RNA, 21 nt, Artificial Sequence
  Description of Artificial Sequence: Synthetic oligonucleotide
  modified_base (20)..(21): 2'-methoxy-nucleotide
uccccaguucauugcacuuuu

SEQ ID NO: 1631 - RNA, 21 nt, Artificial Sequence
  Description of Artificial Sequence: Synthetic oligonucleotide
  modified_base (20)..(21): 2'-methoxy-nucleotide
ccccaguucauugcacuuuuu

SEQ ID NO: 1632 - RNA, 21 nt, Artificial Sequence
  Description of Artificial Sequence: Synthetic oligonucleotide
  modified_base (20)..(21): 2'-methoxy-nucleotide
cccaguucauugcacuuuguu

SEQ ID NO: 1633 - RNA, 21 nt, Artificial Sequence
  Description of Artificial Sequence: Synthetic oligonucleotide
  modified_base (20)..(21): 2'-methoxy-nucleotide
ccaguucauugcacuuugauu

SEQ ID NO: 1634 - RNA, 21 nt, Artificial Sequence
  Description of Artificial Sequence: Synthetic oligonucleotide
  modified_base (20)..(21): 2'-methoxy-nucleotide
caguucauugcacuuugauuu

SEQ ID NO: 1635 - RNA, 21 nt, Artificial Sequence
  Description of Artificial Sequence: Synthetic oligonucleotide
  modified_base (20)..(21): 2'-methoxy-nucleotide
aguucauugcacuuugauuuu

SEQ ID NO: 1636 - RNA, 21 nt, Artificial Sequence
  Description of Artificial Sequence: Synthetic oligonucleotide
  modified_base (20)..(21): 2'-methoxy-nucleotide
guucauugcacuuugauuauu

SEQ ID NO: 1637 - RNA, 21 nt, Artificial Sequence
  Description of Artificial Sequence: Synthetic oligonucleotide
  modified_base (20)..(21): 2'-methoxy-nucleotide
uucauugcacuuugauuaguu

SEQ ID NO: 1638 - RNA, 21 nt, Artificial Sequence
  Description of Artificial Sequence: Synthetic oligonucleotide
  modified_base (20)..(21): 2'-methoxy-nucleotide
ucauugcacuuugauuagcuu

SEQ ID NO: 1639 - RNA, 21 nt, Artificial Sequence
  Description of Artificial Sequence: Synthetic oligonucleotide
  modified_base (20)..(21): 2'-methoxy-nucleotide
cauugcacuuugauuagcauu

SEQ ID NO: 1640 - RNA, 21 nt, Artificial Sequence
  Description of Artificial Sequence: Synthetic oligonucleotide
  modified_base (20)..(21): 2'-methoxy-nucleotide
auugcacuuugauuagcaguu

SEQ ID NO: 1641 - RNA, 21 nt, Artificial Sequence
  Description of Artificial Sequence: Synthetic oligonucleotide
  modified_base (20)..(21): 2'-methoxy-nucleotide
uugcacuuugauuagcagcuu

SEQ ID NO: 1642 - RNA, 21 nt, Artificial Sequence
  Description of Artificial Sequence: Synthetic oligonucleotide
  modified_base (20)..(21): 2'-methoxy-nucleotide
ugcacuuugauuagcagcguu

SEQ ID NO: 1643 - RNA, 21 nt, Artificial Sequence
  Description of Artificial Sequence: Synthetic oligonucleotide
  modified_base (20)..(21): 2'-methoxy-nucleotide
gcacuuugauuagcagcgguu

SEQ ID NO: 1644 - RNA, 21 nt, Artificial Sequence
  Description of Artificial Sequence: Synthetic oligonucleotide
  modified_base (20)..(21): 2'-methoxy-nucleotide
cacuuugauuagcagcggauu

SEQ ID NO: 1645 - RNA, 21 nt, Artificial Sequence
  Description of Artificial Sequence: Synthetic oligonucleotide
  modified_base (20)..(21): 2'-methoxy-nucleotide
acuuugauuagcagcggaauu

SEQ ID NO: 1646 - RNA, 21 nt, Artificial Sequence
  Description of Artificial Sequence: Synthetic oligonucleotide
  modified_base (20)..(21): 2'-methoxy-nucleotide
cuuugauuagcagcggaacuu

SEQ ID NO: 1647 - RNA, 21 nt, Artificial Sequence
  Description of Artificial Sequence: Synthetic oligonucleotide
  modified_base (20)..(21): 2'-methoxy-nucleotide
uuugauuagcagcggaacauu

SEQ ID NO: 1648 - RNA, 21 nt, Artificial Sequence
  Description of Artificial Sequence: Synthetic oligonucleotide
  modified_base (20)..(21): 2'-methoxy-nucleotide
uugauuagcagcggaacaauu

SEQ ID NO: 1649 - RNA, 21 nt, Artificial Sequence
  Description of Artificial Sequence: Synthetic oligonucleotide
  modified_base (20)..(21): 2'-methoxy-nucleotide
ugauuagcagcggaacaaguu

SEQ ID NO: 1650 - RNA, 21 nt, Artificial Sequence
  Description of Artificial Sequence: Synthetic oligonucleotide
  modified_base (20)..(21): 2'-methoxy-nucleotide
gauuagcagcggaacaagguu

SEQ ID NO: 1651 - RNA, 21 nt, Artificial Sequence
  Description of Artificial Sequence: Synthetic oligonucleotide
  modified_base (20)..(21): 2'-methoxy-nucleotide
auuagcagcggaacaaggauu

SEQ ID NO: 1652 - RNA, 21 nt, Artificial Sequence
  Description of Artificial Sequence: Synthetic oligonucleotide
  modified_base (20)..(21): 2'-methoxy-nucleotide
uuagcagcggaacaaggaguu

SEQ ID NO: 1653 - RNA, 21 nt, Artificial Sequence
  Description of Artificial Sequence: Synthetic oligonucleotide
  modified_base (20)..(21): 2'-methoxy-nucleotide
uagcagcggaacaaggaguuu

SEQ ID NO: 1654 - RNA, 21 nt, Artificial Sequence
  Description of Artificial Sequence: Synthetic oligonucleotide
  modified_base (20)..(21): 2'-methoxy-nucleotide
agcagcggaacaaggagucuu

SEQ ID NO: 1655 - RNA, 21 nt, Artificial Sequence
  Description of Artificial Sequence: Synthetic oligonucleotide
  modified_base (20)..(21): 2'-methoxy-nucleotide
gcagcggaacaaggagucauu

SEQ ID NO: 1656 - RNA, 21 nt, Artificial Sequence
  Description of Artificial Sequence: Synthetic oligonucleotide
  modified_base (20)..(21): 2'-methoxy-nucleotide
cagcggaacaaggagucaguu

SEQ ID NO: 1657 - RNA, 21 nt, Artificial Sequence
  Description of Artificial Sequence: Synthetic oligonucleotide
  modified_base (20)..(21): 2'-methoxy-nucleotide
agcggaacaaggagucagauu

SEQ ID NO: 1658 - RNA, 21 nt, Artificial Sequence
  Description of Artificial Sequence: Synthetic oligonucleotide
  modified_base (20)..(21): 2'-methoxy-nucleotide
gcggaacaaggagucagacuu

SEQ ID NO: 1659 - RNA, 21 nt, Artificial Sequence
  Description of Artificial Sequence: Synthetic oligonucleotide
  modified_base (20)..(21): 2'-methoxy-nucleotide
cggaacaaggagucagacauu

SEQ ID NO: 1660 - RNA, 21 nt, Artificial Sequence
  Description of Artificial Sequence: Synthetic oligonucleotide
  modified_base (20)..(21): 2'-methoxy-nucleotide
ggaacaaggagucagacauuu

SEQ ID NO: 1661 - RNA, 21 nt, Artificial Sequence
  Description of Artificial Sequence: Synthetic oligonucleotide
  modified_base (20)..(21): 2'-methoxy-nucleotide
gaacaaggagucagacauuuu

SEQ ID NO: 1662 - RNA, 21 nt, Artificial Sequence
  Description of Artificial Sequence: Synthetic oligonucleotide
  modified_base (20)..(21): 2'-methoxy-nucleotide
aacaaggagucagacauuuuu

SEQ ID NO: 1663 - RNA, 21 nt, Artificial Sequence
  Description of Artificial Sequence: Synthetic oligonucleotide
  modified_base (20)..(21): 2'-methoxy-nucleotide
acaaggagucagacauuuuuu

SEQ ID NO: 1664 - RNA, 21 nt, Artificial Sequence
  Description of Artificial Sequence: Synthetic oligonucleotide
  modified_base (20)..(21): 2'-methoxy-nucleotide
caaggagucagacauuuuauu

SEQ ID NO: 1665 - RNA, 21 nt, Artificial Sequence
  Description of Artificial Sequence: Synthetic oligonucleotide
  modified_base (20)..(21): 2'-methoxy-nucleotide
aaggagucagacauuuuaauu

SEQ ID NO: 1666 - RNA, 21 nt, Artificial Sequence
  Description of Artificial Sequence: Synthetic oligonucleotide
  modified_base (20)..(21): 2'-methoxy-nucleotide
aggagucagacauuuuaaguu

SEQ ID NO: 1667 - RNA, 21 nt, Artificial Sequence
  Description of Artificial Sequence: Synthetic oligonucleotide
  modified_base (20)..(21): 2'-methoxy-nucleotide
ggagucagacauuuuaagauu

SEQ ID NO: 1668 - RNA, 21 nt, Artificial Sequence
  Description of Artificial Sequence: Synthetic oligonucleotide
  modified_base (20)..(21): 2'-methoxy-nucleotide
gagucagacauuuuaagauuu

SEQ ID NO: 1669 - RNA, 21 nt, Artificial Sequence
  Description of Artificial Sequence: Synthetic oligonucleotide
  modified_base (20)..(21): 2'-methoxy-nucleotide
agucagacauuuuaagauguu

SEQ ID NO: 1670 - RNA, 21 nt, Artificial Sequence
  Description of Artificial Sequence: Synthetic oligonucleotide
  modified_base (20)..(21): 2'-methoxy-nucleotide
gucagacauuuuaagaugguu

SEQ ID NO: 1671 - RNA, 21 nt, Artificial Sequence
  Description of Artificial Sequence: Synthetic oligonucleotide
  modified_base (20)..(21): 2'-methoxy-nucleotide
ucagacauuuuaagaugguuu

SEQ ID NO: 1672 - RNA, 21 nt, Artificial Sequence
  Description of Artificial Sequence: Synthetic oligonucleotide
  modified_base (20)..(21): 2'-methoxy-nucleotide
cagacauuuuaagaugguguu

SEQ ID NO: 1673 - RNA, 21 nt, Artificial Sequence
  Description of Artificial Sequence: Synthetic oligonucleotide
  modified_base (20)..(21): 2'-methoxy-nucleotide
agacauuuuaagauggugguu

SEQ ID NO: 1674 - RNA, 21 nt, Artificial Sequence
  Description of Artificial Sequence: Synthetic oligonucleotide
  modified_base (20)..(21): 2'-methoxy-nucleotide
gacauuuuaagaugguggcuu

SEQ ID NO: 1675 - RNA, 21 nt, Artificial Sequence
  Description of Artificial Sequence: Synthetic oligonucleotide
  modified_base (20)..(21): 2'-methoxy-nucleotide
acauuuuaagaugguggcauu

SEQ ID NO: 1676 - RNA, 21 nt, Artificial Sequence
  Description of Artificial Sequence: Synthetic oligonucleotide
  modified_base (20)..(21): 2'-methoxy-nucleotide
cauuuuaagaugguggcaguu

SEQ ID NO: 1677 - RNA, 21 nt, Artificial Sequence
  Description of Artificial Sequence: Synthetic oligonucleotide
  modified_base (20)..(21): 2'-methoxy-nucleotide
auuuuaagaugguggcaguuu

SEQ ID NO: 1678 - RNA, 21 nt, Artificial Sequence
  Description of Artificial Sequence: Synthetic oligonucleotide
  modified_base (20)..(21): 2'-methoxy-nucleotide
uuuuaagaugguggcaguauu

SEQ ID NO: 1679 - RNA, 21 nt, Artificial Sequence
  Description of Artificial Sequence: Synthetic oligonucleotide
  modified_base (20)..(21): 2'-methoxy-nucleotide
uuuaagaugguggcaguaguu

SEQ ID NO: 1680 - RNA, 21 nt, Artificial Sequence
  Description of Artificial Sequence: Synthetic oligonucleotide
  modified_base (20)..(21): 2'-methoxy-nucleotide
uuaagaugguggcaguagauu

SEQ ID NO: 1681 - RNA, 21 nt, Artificial Sequence
  Description of Artificial Sequence: Synthetic oligonucleotide
  modified_base (20)..(21): 2'-methoxy-nucleotide
uaagaugguggcaguagaguu

SEQ ID NO: 1682 - RNA, 21 nt, Artificial Sequence
  Description of Artificial Sequence: Synthetic oligonucleotide
  modified_base (20)..(21): 2'-methoxy-nucleotide
aagaugguggcaguagagguu

SEQ ID NO: 1683 - RNA, 21 nt, Artificial Sequence
  Description of Artificial Sequence: Synthetic oligonucleotide
  modified_base (20)..(21): 2'-methoxy-nucleotide
agaugguggcaguagaggcuu

SEQ ID NO: 1684 - RNA, 21 nt, Artificial Sequence
  Description of Artificial Sequence: Synthetic oligonucleotide
  modified_base (20)..(21): 2'-methoxy-nucleotide
gaugguggcaguagaggcuuu

SEQ ID NO: 1685 - RNA, 21 nt, Artificial Sequence
  Description of Artificial Sequence: Synthetic oligonucleotide
  modified_base (20)..(21): 2'-methoxy-nucleotide
augguggcaguagaggcuauu

SEQ ID NO: 1686 - RNA, 21 nt, Artificial Sequence
  Description of Artificial Sequence: Synthetic oligonucleotide
  modified_base (20)..(21): 2'-methoxy-nucleotide
ugguggcaguagaggcuauuu

SEQ ID NO: 1687 - RNA, 21 nt, Artificial Sequence
  Description of Artificial Sequence: Synthetic oligonucleotide
  modified_base (20)..(21): 2'-methoxy-nucleotide
gguggcaguagaggcuauguu

SEQ ID NO: 1688 - RNA, 21 nt, Artificial Sequence
  Description of Artificial Sequence: Synthetic oligonucleotide
  modified_base (20)..(21): 2'-methoxy-nucleotide
guggcaguagaggcuaugguu

SEQ ID NO: 1689 - RNA, 21 nt, Artificial Sequence
  Description of Artificial Sequence: Synthetic oligonucleotide
  modified_base (20)..(21): 2'-methoxy-nucleotide
uggcaguagaggcuauggauu

SEQ ID NO: 1690 - RNA, 21 nt, Artificial Sequence
  Description of Artificial Sequence: Synthetic oligonucleotide
  modified_base (20)..(21): 2'-methoxy-nucleotide
ggcaguagaggcuauggacuu

SEQ ID NO: 1691 - RNA, 21 nt, Artificial Sequence
  Description of Artificial Sequence: Synthetic oligonucleotide
  modified_base (20)..(21): 2'-methoxy-nucleotide
gcaguagaggcuauggacauu

SEQ ID NO: 1692 - RNA, 21 nt, Artificial Sequence
  Description of Artificial Sequence: Synthetic oligonucleotide
  modified_base (20)..(21): 2'-methoxy-nucleotide
caguagaggcuauggacaguu

SEQ ID NO: 1693 - RNA, 21 nt, Artificial Sequence
  Description of Artificial Sequence: Synthetic oligonucleotide
  modified_base (20)..(21): 2'-methoxy-nucleotide
aguagaggcuauggacagguu

SEQ ID NO: 1694 - RNA, 21 nt, Artificial Sequence
  Description of Artificial Sequence: Synthetic oligonucleotide
  modified_base (20)..(21): 2'-methoxy-nucleotide
guagaggcuauggacaggguu

SEQ ID NO: 1695 - RNA, 21 nt, Artificial Sequence
  Description of Artificial Sequence: Synthetic oligonucleotide
  modified_base (20)..(21): 2'-methoxy-nucleotide
uagaggcuauggacagggcuu

SEQ ID NO: 1696 - RNA, 21 nt, Artificial Sequence
  Description of Artificial Sequence: Synthetic oligonucleotide
  modified_base (20)..(21): 2'-methoxy-nucleotide
agaggcuauggacagggcauu

SEQ ID NO: 1697 - RNA, 21 nt, Artificial Sequence
  Description of Artificial Sequence: Synthetic oligonucleotide
  modified_base (20)..(21): 2'-methoxy-nucleotide
gaggcuauggacagggcauuu

SEQ ID NO: 1698 - RNA, 21 nt, Artificial Sequence
  Description of Artificial Sequence: Synthetic oligonucleotide
  modified_base (20)..(21): 2'-methoxy-nucleotide
aggcuauggacagggcauguu

SEQ ID NO: 1699 - RNA, 21 nt, Artificial Sequence
  Description of Artificial Sequence: Synthetic oligonucleotide
  modified_base (20)..(21): 2'-methoxy-nucleotide
ggcuauggacagggcaugcuu

SEQ ID NO: 1700 - RNA, 21 nt, Artificial Sequence
  Description of Artificial Sequence: Synthetic oligonucleotide
  modified_base (20)..(21): 2'-methoxy-nucleotide
gcuauggacagggcaugccuu

SEQ ID NO: 1701 - RNA, 21 nt, Artificial Sequence
  Description of Artificial Sequence: Synthetic oligonucleotide
  modified_base (20)..(21): 2'-methoxy-nucleotide
cuauggacagggcaugccauu

SEQ ID NO: 1702 - RNA, 21 nt, Artificial Sequence
  Description of Artificial Sequence: Synthetic oligonucleotide
  modified_base (20)..(21): 2'-methoxy-nucleotide
uauggacagggcaugccacuu

SEQ ID NO: 1703 - RNA, 21 nt, Artificial Sequence
  Description of Artificial Sequence: Synthetic oligonucleotide
  modified_base (20)..(21): 2'-methoxy-nucleotide
auggacagggcaugccacguu

SEQ ID NO: 1704 - RNA, 21 nt, Artificial Sequence
  Description of Artificial Sequence: Synthetic oligonucleotide
  modified_base (20)..(21): 2'-methoxy-nucleotide
uggacagggcaugccacguuu

SEQ ID NO: 1705 - RNA, 21 nt, Artificial Sequence
  Description of Artificial Sequence: Synthetic oligonucleotide
  modified_base (20)..(21): 2'-methoxy-nucleotide
ggacagggcaugccacguguu

SEQ ID NO: 1706 - RNA, 21 nt, Artificial Sequence
  Description of Artificial Sequence: Synthetic oligonucleotide
  modified_base (20)..(21): 2'-methoxy-nucleotide
gacagggcaugccacgugguu

SEQ ID NO: 1707 - RNA, 21 nt, Artificial Sequence
  Description of Artificial Sequence: Synthetic oligonucleotide
  modified_base (20)..(21): 2'-methoxy-nucleotide
acagggcaugccacguggguu

SEQ ID NO: 1708 - RNA, 21 nt, Artificial Sequence
  Description of Artificial Sequence: Synthetic oligonucleotide
  modified_base (20)..(21): 2'-methoxy-nucleotide
cagggcaugccacgugggcuu

SEQ ID NO: 1709 - RNA, 21 nt, Artificial Sequence
  Description of Artificial Sequence: Synthetic oligonucleotide
  modified_base (20)..(21): 2'-methoxy-nucleotide
agggcaugccacgugggcuuu

SEQ ID NO: 1710 - RNA, 21 nt, Artificial Sequence
  Description of Artificial Sequence: Synthetic oligonucleotide
  modified_base (20)..(21): 2'-methoxy-nucleotide
gggcaugccacgugggcucuu

SEQ ID NO: 1711 - RNA, 21 nt, Artificial Sequence
  Description of Artificial Sequence: Synthetic oligonucleotide
  modified_base (20)..(21): 2'-methoxy-nucleotide
ggcaugccacgugggcucauu

SEQ ID NO: 1712 - RNA, 21 nt, Artificial Sequence
  Description of Artificial Sequence: Synthetic oligonucleotide
  modified_base (20)..(21): 2'-methoxy-nucleotide
gcaugccacgugggcucauuu

SEQ ID NO: 1713 - RNA, 21 nt, Artificial Sequence
  Description of Artificial Sequence: Synthetic oligonucleotide
  modified_base (20)..(21): 2'-methoxy-nucleotide
caugccacgugggcucauauu

SEQ ID NO: 1714 - RNA, 21 nt, Artificial Sequence
  Description of Artificial Sequence: Synthetic oligonucleotide
  modified_base (20)..(21): 2'-methoxy-nucleotide
augccacgugggcucauauuu

SEQ ID NO: 1715 - RNA, 21 nt, Artificial Sequence
  Description of Artificial Sequence: Synthetic oligonucleotide
  modified_base (20)..(21): 2'-methoxy-nucleotide
ugccacgugggcucauauguu

SEQ ID NO: 1716 - RNA, 21 nt, Artificial Sequence
  Description of Artificial Sequence: Synthetic oligonucleotide
  modified_base (20)..(21): 2'-methoxy-nucleotide
gccacgugggcucauaugguu

SEQ ID NO: 1717 - RNA, 21 nt, Artificial Sequence
  Description of Artificial Sequence: Synthetic oligonucleotide
  modified_base (20)..(21): 2'-methoxy-nucleotide
ccacgugggcucauauggguu

SEQ ID NO: 1718 - RNA, 21 nt, Artificial Sequence
  Description of Artificial Sequence: Synthetic oligonucleotide
  modified_base (20)..(21): 2'-methoxy-nucleotide
cacgugggcucauaugggguu

SEQ ID NO: 1719 - RNA, 21 nt, Artificial Sequence
  Description of Artificial Sequence: Synthetic oligonucleotide
  modified_base (20)..(21): 2'-methoxy-nucleotide
acgugggcucauauggggcuu

SEQ ID NO: 1720 - RNA, 21 nt, Artificial Sequence
  Description of Artificial Sequence: Synthetic oligonucleotide
  modified_base (20)..(21): 2'-methoxy-nucleotide
cgugggcucauauggggcuuu

SEQ ID NO: 1721 - RNA, 21 nt, Artificial Sequence
  Description of Artificial Sequence: Synthetic oligonucleotide
  modified_base (20)..(21): 2'-methoxy-nucleotide
gugggcucauauggggcuguu

SEQ ID NO: 1722 - RNA, 21 nt, Artificial Sequence
  Description of Artificial Sequence: Synthetic oligonucleotide
  modified_base (20)..(21): 2'-methoxy-nucleotide
ugggcucauauggggcugguu

SEQ ID NO: 1723 - RNA, 21 nt, Artificial Sequence
  Description of Artificial Sequence: Synthetic oligonucleotide
  modified_base (20)..(21): 2'-methoxy-nucleotide
gggcucauauggggcuggguu

SEQ ID NO: 1724 - RNA, 21 nt, Artificial Sequence
  Description of Artificial Sequence: Synthetic oligonucleotide
  modified_base (20)..(21): 2'-methoxy-nucleotide
ggcucauauggggcugggauu

SEQ ID NO: 1725 - RNA, 21 nt, Artificial Sequence
  Description of Artificial Sequence: Synthetic oligonucleotide
  modified_base (20)..(21): 2'-methoxy-nucleotide
gcucauauggggcugggaguu

SEQ ID NO: 1726 - RNA, 21 nt, Artificial Sequence
  Description of Artificial Sequence: Synthetic oligonucleotide
  modified_base (20)..(21): 2'-methoxy-nucleotide
cucauauggggcugggaguuu

SEQ ID NO: 1727 - RNA, 21 nt, Artificial Sequence
  Description of Artificial Sequence: Synthetic oligonucleotide
  modified_base (20)..(21): 2'-methoxy-nucleotide
ucauauggggcugggaguauu

SEQ ID NO: 1728 - RNA, 21 nt, Artificial Sequence
  Description of Artificial Sequence: Synthetic oligonucleotide
  modified_base (20)..(21): 2'-methoxy-nucleotide
cauauggggcugggaguaguu

SEQ ID NO: 1729 - RNA, 21 nt, Artificial Sequence
  Description of Artificial Sequence: Synthetic oligonucleotide
  modified_base (20)..(21): 2'-methoxy-nucleotide
auauggggcugggaguaguuu

SEQ ID NO: 1730 - RNA, 21 nt, Artificial Sequence
  Description of Artificial Sequence: Synthetic oligonucleotide
  modified_base (20)..(21): 2'-methoxy-nucleotide
uauggggcugggaguaguuuu

SEQ ID NO: 1731 - RNA, 21 nt, Artificial Sequence
  Description of Artificial Sequence: Synthetic oligonucleotide
  modified_base (20)..(21): 2'-methoxy-nucleotide
auggggcugggaguaguuguu

SEQ ID NO: 1732 - RNA, 21 nt, Artificial Sequence
  Description of Artificial Sequence: Synthetic oligonucleotide
  modified_base (20)..(21): 2'-methoxy-nucleotide
uggggcugggaguaguuguuu

SEQ ID NO: 1733 - RNA, 21 nt, Artificial Sequence
  Description of Artificial Sequence: Synthetic oligonucleotide
  modified_base (20)..(21): 2'-methoxy-nucleotide
ggggcugggaguaguugucuu

SEQ ID NO: 1734 - RNA, 21 nt, Artificial Sequence
  Description of Artificial Sequence: Synthetic oligonucleotide
  modified_base (20)..(21): 2'-methoxy-nucleotide
gggcugggaguaguugucuuu

SEQ ID NO: 1735 - RNA, 21 nt, Artificial Sequence
  Description of Artificial Sequence: Synthetic oligonucleotide
  modified_base (20)..(21): 2'-methoxy-nucleotide
ggcugggaguaguugucuuuu

SEQ ID NO: 1736 - RNA, 21 nt, Artificial Sequence
  Description of Artificial Sequence: Synthetic oligonucleotide
  modified_base (20)..(21): 2'-methoxy-nucleotide
gcugggaguaguugucuuuuu

SEQ ID NO: 1737 - RNA, 21 nt, Artificial Sequence
  Description of Artificial Sequence: Synthetic oligonucleotide
  modified_base (20)..(21): 2'-methoxy-nucleotide
cugggaguaguugucuuucuu

SEQ ID NO: 1738 - RNA, 21 nt, Artificial Sequence
  Description of Artificial Sequence: Synthetic oligonucleotide
  modified_base (20)..(21): 2'-methoxy-nucleotide
ugggaguaguugucuuuccuu

SEQ ID NO: 1739 - RNA, 21 nt, Artificial Sequence
  Description of Artificial Sequence: Synthetic oligonucleotide
  modified_base (20)..(21): 2'-methoxy-nucleotide
gggaguaguugucuuuccuuu

SEQ ID NO: 1740 - RNA, 21 nt, Artificial Sequence
  Description of Artificial Sequence: Synthetic oligonucleotide
  modified_base (20)..(21): 2'-methoxy-nucleotide
ggaguaguugucuuuccuguu

SEQ ID NO: 1741 - RNA, 21 nt, Artificial Sequence
  Description of Artificial Sequence: Synthetic oligonucleotide
  modified_base (20)..(21): 2'-methoxy-nucleotide
gaguaguugucuuuccugguu

SEQ ID NO: 1742 - RNA, 21 nt, Artificial Sequence
  Description of Artificial Sequence: Synthetic oligonucleotide
  modified_base (20)..(21): 2'-methoxy-nucleotide
aguaguugucuuuccuggcuu

SEQ ID NO: 1743 - RNA, 21 nt, Artificial Sequence
  Description of Artificial Sequence: Synthetic oligonucleotide
  modified_base (20)..(21): 2'-methoxy-nucleotide
guaguugucuuuccuggcauu

SEQ ID NO: 1744 - RNA, 21 nt, Artificial Sequence
  Description of Artificial Sequence: Synthetic oligonucleotide
  modified_base (20)..(21): 2'-methoxy-nucleotide
uaguugucuuuccuggcacuu

SEQ ID NO: 1745 - RNA, 21 nt, Artificial Sequence
  Description of Artificial Sequence: Synthetic oligonucleotide
  modified_base (20)..(21): 2'-methoxy-nucleotide
aguugucuuuccuggcacuuu

SEQ ID NO: 1746 - RNA, 21 nt, Artificial Sequence
  Description of Artificial Sequence: Synthetic oligonucleotide
  modified_base (20)..(21): 2'-methoxy-nucleotide
guugucuuuccuggcacuauu

SEQ ID NO: 1747 - RNA, 21 nt, Artificial Sequence
  Description of Artificial Sequence: Synthetic oligonucleotide
  modified_base (20)..(21): 2'-methoxy-nucleotide
uugucuuuccuggcacuaauu

SEQ ID NO: 1748 - RNA, 21 nt, Artificial Sequence
  Description of Artificial Sequence: Synthetic oligonucleotide
  modified_base (20)..(21): 2'-methoxy-nucleotide
ugucuuuccuggcacuaacuu

SEQ ID NO: 1749 - RNA, 21 nt, Artificial Sequence
  Description of Artificial Sequence: Synthetic oligonucleotide
  modified_base (20)..(21): 2'-methoxy-nucleotide
gucuuuccuggcacuaacguu

SEQ ID NO: 1750 - RNA, 21 nt, Artificial Sequence
  Description of Artificial Sequence: Synthetic oligonucleotide
  modified_base (20)..(21): 2'-methoxy-nucleotide
ucuuuccuggcacuaacguuu

SEQ ID NO: 1751 - RNA, 21 nt, Artificial Sequence
  Description of Artificial Sequence: Synthetic oligonucleotide
  modified_base (20)..(21): 2'-methoxy-nucleotide
cuuuccuggcacuaacguuuu

SEQ ID NO: 1752 - RNA, 21 nt, Artificial Sequence
  Description of Artificial Sequence: Synthetic oligonucleotide
  modified_base (20)..(21): 2'-methoxy-nucleotide
uuuccuggcacuaacguuguu

SEQ ID NO: 1753 - RNA, 21 nt, Artificial Sequence
  Description of Artificial Sequence: Synthetic oligonucleotide
  modified_base (20)..(21): 2'-methoxy-nucleotide
uuccuggcacuaacguugauu

SEQ ID NO: 1754 - RNA, 21 nt, Artificial Sequence
  Description of Artificial Sequence: Synthetic oligonucleotide
  modified_base (20)..(21): 2'-methoxy-nucleotide
uccuggcacuaacguugaguu

SEQ ID NO: 1755 - RNA, 21 nt, Artificial Sequence
  Description of Artificial Sequence: Synthetic oligonucleotide
  modified_base (20)..(21): 2'-methoxy-nucleotide
ccuggcacuaacguugagcuu

SEQ ID NO: 1756 - RNA, 21 nt, Artificial Sequence
  Description of Artificial Sequence: Synthetic oligonucleotide
  modified_base (20)..(21): 2'-methoxy-nucleotide
cuggcacuaacguugagccuu

SEQ ID NO: 1757 - RNA, 21 nt, Artificial Sequence
  Description of Artificial Sequence: Synthetic oligonucleotide
  modified_base (20)..(21): 2'-methoxy-nucleotide
uggcacuaacguugagcccuu

SEQ ID NO: 1758 - RNA, 21 nt, Artificial Sequence
  Description of Artificial Sequence: Synthetic oligonucleotide
  modified_base (20)..(21): 2'-methoxy-nucleotide
ggcacuaacguugagccccuu

SEQ ID NO: 1759 - RNA, 21 nt, Artificial Sequence
  Description of Artificial Sequence: Synthetic oligonucleotide
  modified_base (20)..(21): 2'-methoxy-nucleotide
gcacuaacguugagccccuuu

SEQ ID NO: 1760 - RNA, 21 nt, Artificial Sequence
  Description of Artificial Sequence: Synthetic oligonucleotide
  modified_base (20)..(21): 2'-methoxy-nucleotide
cacuaacguugagccccuguu

SEQ ID NO: 1761 - RNA, 21 nt, Artificial Sequence
  Description of Artificial Sequence: Synthetic oligonucleotide
  modified_base (20)..(21): 2'-methoxy-nucleotide
acuaacguugagccccugguu

SEQ ID NO: 1762 - RNA, 21 nt, Artificial Sequence
  Description of Artificial Sequence: Synthetic oligonucleotide
  modified_base (20)..(21): 2'-methoxy-nucleotide
cuaacguugagccccuggauu

SEQ ID NO: 1763 - RNA, 21 nt, Artificial Sequence
  Description of Artificial Sequence: Synthetic oligonucleotide
  modified_base (20)..(21): 2'-methoxy-nucleotide
uaacguugagccccuggaguu

SEQ ID NO: 1764 - RNA, 21 nt, Artificial Sequence
  Description of Artificial Sequence: Synthetic oligonucleotide
  modified_base (20)..(21): 2'-methoxy-nucleotide
aacguugagccccuggagguu

SEQ ID NO: 1765 - RNA, 21 nt, Artificial Sequence
  Description of Artificial Sequence: Synthetic oligonucleotide
  modified_base (20)..(21): 2'-methoxy-nucleotide
acguugagccccuggaggcuu

SEQ ID NO: 1766 - RNA, 21 nt, Artificial Sequence
  Description of Artificial Sequence: Synthetic oligonucleotide
  modified_base (20)..(21): 2'-methoxy-nucleotide
cguugagccccuggaggcauu

SEQ ID NO: 1767 - RNA, 21 nt, Artificial Sequence
  Description of Artificial Sequence: Synthetic oligonucleotide
  modified_base (20)..(21): 2'-methoxy-nucleotide
guugagccccuggaggcacuu

SEQ ID NO: 1768 - RNA, 21 nt, Artificial Sequence
  Description of Artificial Sequence: Synthetic oligonucleotide
  modified_base (20)..(21): 2'-methoxy-nucleotide
uugagccccuggaggcacuuu

SEQ ID NO: 1769 - RNA, 21 nt, Artificial Sequence
  Description of Artificial Sequence: Synthetic oligonucleotide
  modified_base (20)..(21): 2'-methoxy-nucleotide
ugagccccuggaggcacuguu

SEQ ID NO: 1770 - RNA, 21 nt, Artificial Sequence
  Description of Artificial Sequence: Synthetic oligonucleotide
  modified_base (20)..(21): 2'-methoxy-nucleotide
gagccccuggaggcacugauu

SEQ ID NO: 1771 - RNA, 21 nt, Artificial Sequence
  Description of Artificial Sequence: Synthetic oligonucleotide
  modified_base (20)..(21): 2'-methoxy-nucleotide
agccccuggaggcacugaauu

SEQ ID NO: 1772 - RNA, 21 nt, Artificial Sequence
  Description of Artificial Sequence: Synthetic oligonucleotide
  modified_base (20)..(21): 2'-methoxy-nucleotide
gccccuggaggcacugaaguu

SEQ ID NO: 1773 - RNA, 21 nt, Artificial Sequence
  Description of Artificial Sequence: Synthetic oligonucleotide
  modified_base (20)..(21): 2'-methoxy-nucleotide
ccccuggaggcacugaaguuu

SEQ ID NO: 1774 - RNA, 21 nt, Artificial Sequence
  Description of Artificial Sequence: Synthetic oligonucleotide
  modified_base (20)..(21): 2'-methoxy-nucleotide
cccuggaggcacugaaguguu

SEQ ID NO: 1775 - RNA, 21 nt, Artificial Sequence
  Description of Artificial Sequence: Synthetic oligonucleotide
  modified_base (20)..(21): 2'-methoxy-nucleotide
ccuggaggcacugaagugcuu

SEQ ID NO: 1776 - RNA, 21 nt, Artificial Sequence
  Description of Artificial Sequence: Synthetic oligonucleotide
  modified_base (20)..(21): 2'-methoxy-nucleotide
cuggaggcacugaagugcuuu

SEQ ID NO: 1777 - RNA, 21 nt, Artificial Sequence
  Description of Artificial Sequence: Synthetic oligonucleotide
  modified_base (20)..(21): 2'-methoxy-nucleotide
uggaggcacugaagugcuuuu

SEQ ID NO: 1778 - RNA, 21 nt, Artificial Sequence
  Description of Artificial Sequence: Synthetic oligonucleotide
  modified_base (20)..(21): 2'-methoxy-nucleotide
ggaggcacugaagugcuuauu

SEQ ID NO: 1779 - RNA, 21 nt, Artificial Sequence
  Description of Artificial Sequence: Synthetic oligonucleotide
  modified_base (20)..(21): 2'-methoxy-nucleotide
gaggcacugaagugcuuaguu

SEQ ID NO: 1780 - RNA, 21 nt, Artificial Sequence
  Description of Artificial Sequence: Synthetic oligonucleotide
  modified_base (20)..(21): 2'-methoxy-nucleotide
aggcacugaagugcuuaguuu

SEQ ID NO: 1781 - RNA, 21 nt, Artificial Sequence
  Description of Artificial Sequence: Synthetic oligonucleotide
  modified_base (20)..(21): 2'-methoxy-nucleotide
ggcacugaagugcuuaguguu

SEQ ID NO: 1782 - RNA, 21 nt, Artificial Sequence
  Description of Artificial Sequence: Synthetic oligonucleotide
  modified_base (20)..(21): 2'-methoxy-nucleotide
gcacugaagugcuuaguguuu

SEQ ID NO: 1783 - RNA, 21 nt, Artificial Sequence
  Description of Artificial Sequence: Synthetic oligonucleotide
  modified_base (20)..(21): 2'-methoxy-nucleotide
cacugaagugcuuaguguauu

SEQ ID NO: 1784 - RNA, 21 nt, Artificial Sequence
  Description of Artificial Sequence: Synthetic oligonucleotide
  modified_base (20)..(21): 2'-methoxy-nucleotide
acugaagugcuuaguguacuu

SEQ ID NO: 1785 - RNA, 21 nt, Artificial Sequence
  Description of Artificial Sequence: Synthetic oligonucleotide
  modified_base (20)..(21): 2'-methoxy-nucleotide
cugaagugcuuaguguacuuu

SEQ ID NO: 1786 - RNA, 21 nt, Artificial Sequence
  Description of Artificial Sequence: Synthetic oligonucleotide
  modified_base (20)..(21): 2'-methoxy-nucleotide
ugaagugcuuaguguacuuuu

SEQ ID NO: 1787 - RNA, 21 nt, Artificial Sequence
  Description of Artificial Sequence: Synthetic oligonucleotide
  modified_base (20)..(21): 2'-methoxy-nucleotide
gaagugcuuaguguacuuguu

SEQ ID NO: 1788 - RNA, 21 nt, Artificial Sequence
  Description of Artificial Sequence: Synthetic oligonucleotide
  modified_base (20)..(21): 2'-methoxy-nucleotide
aagugcuuaguguacuugguu

SEQ ID NO: 1789 - RNA, 21 nt, Artificial Sequence
  Description of Artificial Sequence: Synthetic oligonucleotide
  modified_base (20)..(21): 2'-methoxy-nucleotide
agugcuuaguguacuuggauu

SEQ ID NO: 1790 - RNA, 21 nt, Artificial Sequence
  Description of Artificial Sequence: Synthetic oligonucleotide
  modified_base (20)..(21): 2'-methoxy-nucleotide
gugcuuaguguacuuggaguu

SEQ ID NO: 1791 - RNA, 21 nt, Artificial Sequence
  Description of Artificial Sequence: Synthetic oligonucleotide
  modified_base (20)..(21): 2'-methoxy-nucleotide
ugcuuaguguacuuggaguuu

SEQ ID NO: 1792 - RNA, 21 nt, Artificial Sequence
  Description of Artificial Sequence: Synthetic oligonucleotide
  modified_base (20)..(21): 2'-methoxy-nucleotide
gcuuaguguacuuggaguauu

SEQ ID NO: 1793 - RNA, 21 nt, Artificial Sequence
  Description of Artificial Sequence: Synthetic oligonucleotide
  modified_base (20)..(21): 2'-methoxy-nucleotide
cuuaguguacuuggaguauuu

SEQ ID NO: 1794 - RNA, 21 nt, Artificial Sequence
  Description of Artificial Sequence: Synthetic oligonucleotide
  modified_base (20)..(21): 2'-methoxy-nucleotide
uuaguguacuuggaguauuuu

SEQ ID NO: 1795 - RNA, 21 nt, Artificial Sequence
  Description of Artificial Sequence: Synthetic oligonucleotide
  modified_base (20)..(21): 2'-methoxy-nucleotide
uaguguacuuggaguauuguu

SEQ ID NO: 1796 - RNA, 21 nt, Artificial Sequence
  Description of Artificial Sequence: Synthetic oligonucleotide
  modified_base (20)..(21): 2'-methoxy-nucleotide
aguguacuuggaguauugguu

SEQ ID NO: 1797 - RNA, 21 nt, Artificial Sequence
  Description of Artificial Sequence: Synthetic oligonucleotide
  modified_base (20)..(21): 2'-methoxy-nucleotide
guguacuuggaguauuggguu

SEQ ID NO: 1798 - RNA, 21 nt, Artificial Sequence
  Description of Artificial Sequence: Synthetic oligonucleotide
  modified_base (20)..(21): 2'-methoxy-nucleotide
uguacuuggaguauugggguu

SEQ ID NO: 1799 - RNA, 21 nt, Artificial Sequence
  Description of Artificial Sequence: Synthetic oligonucleotide
  modified_base (20)..(21): 2'-methoxy-nucleotide
guacuuggaguauugggguuu

SEQ ID NO: 1800 - RNA, 21 nt, Artificial Sequence
  Description of Artificial Sequence: Synthetic oligonucleotide
  modified_base (20)..(21): 2'-methoxy-nucleotide
uacuuggaguauuggggucuu

SEQ ID NO: 1801 - RNA, 21 nt, Artificial Sequence
  Description of Artificial Sequence: Synthetic oligonucleotide
  modified_base (20)..(21): 2'-methoxy-nucleotide
acuuggaguauuggggucuuu

SEQ ID NO: 1802 - RNA, 21 nt, Artificial Sequence
  Description of Artificial Sequence: Synthetic oligonucleotide
  modified_base (20)..(21): 2'-methoxy-nucleotide
cuuggaguauuggggucuguu

SEQ ID NO: 1803 - RNA, 21 nt, Artificial Sequence
  Description of Artificial Sequence: Synthetic oligonucleotide
  modified_base (20)..(21): 2'-methoxy-nucleotide
uuggaguauuggggucugauu

SEQ ID NO: 1804 - RNA, 21 nt, Artificial Sequence
  Description of Artificial Sequence: Synthetic oligonucleotide
  modified_base (20)..(21): 2'-methoxy-nucleotide
uggaguauuggggucugacuu

SEQ ID NO: 1805 - RNA, 21 nt, Artificial Sequence
  Description of Artificial Sequence: Synthetic oligonucleotide
  modified_base (20)..(21): 2'-methoxy-nucleotide
ggaguauuggggucugaccuu

SEQ ID NO: 1806 - RNA, 21 nt, Artificial Sequence
  Description of Artificial Sequence: Synthetic oligonucleotide
  modified_base (20)..(21): 2'-methoxy-nucleotide
gaguauuggggucugacccuu

SEQ ID NO: 1807 - RNA, 21 nt, Artificial Sequence
  Description of Artificial Sequence: Synthetic oligonucleotide
  modified_base (20)..(21): 2'-methoxy-nucleotide
aguauuggggucugaccccuu

SEQ ID NO: 1808 - RNA, 21 nt, Artificial Sequence
  Description of Artificial Sequence: Synthetic oligonucleotide
  modified_base (20)..(21): 2'-methoxy-nucleotide
guauuggggucugaccccauu

SEQ ID NO: 1809 - RNA, 21 nt, Artificial Sequence
  Description of Artificial Sequence: Synthetic oligonucleotide
  modified_base (20)..(21): 2'-methoxy-nucleotide
uauuggggucugaccccaauu

SEQ ID NO: 1810 - RNA, 21 nt, Artificial Sequence
  Description of Artificial Sequence: Synthetic oligonucleotide
  modified_base (20)..(21): 2'-methoxy-nucleotide
auuggggucugaccccaaauu

SEQ ID NO: 1811 - RNA, 21 nt, Artificial Sequence
  Description of Artificial Sequence: Synthetic oligonucleotide
  modified_base (20)..(21): 2'-methoxy-nucleotide
uuggggucugaccccaaacuu

SEQ ID NO: 1812 - RNA, 21 nt, Artificial Sequence
  Description of Artificial Sequence: Synthetic oligonucleotide
  modified_base (20)..(21): 2'-methoxy-nucleotide
uggggucugaccccaaacauu

SEQ ID NO: 1813 - RNA, 21 nt, Artificial Sequence
  Description of Artificial Sequence: Synthetic oligonucleotide
  modified_base (20)..(21): 2'-methoxy-nucleotide
ggggucugaccccaaacacuu

SEQ ID NO: 1814 - RNA, 21 nt, Artificial Sequence
  Description of Artificial Sequence: Synthetic oligonucleotide
  modified_base (20)..(21): 2'-methoxy-nucleotide
gggucugaccccaaacaccuu

SEQ ID NO: 1815 - RNA, 21 nt, Artificial Sequence
  Description of Artificial Sequence: Synthetic oligonucleotide
  modified_base (20)..(21): 2'-methoxy-nucleotide
ggucugaccccaaacaccuuu

SEQ ID NO: 1816 - RNA, 21 nt, Artificial Sequence
  Description of Artificial Sequence: Synthetic oligonucleotide
  modified_base (20)..(21): 2'-methoxy-nucleotide
gucugaccccaaacaccuuuu

SEQ ID NO: 1817 - RNA, 21 nt, Artificial Sequence
  Description of Artificial Sequence: Synthetic oligonucleotide
  modified_base (20)..(21): 2'-methoxy-nucleotide
ucugaccccaaacaccuucuu

SEQ ID NO: 1818 - RNA, 21 nt, Artificial Sequence
  Description of Artificial Sequence: Synthetic oligonucleotide
  modified_base (20)..(21): 2'-methoxy-nucleotide
cugaccccaaacaccuuccuu

SEQ ID NO: 1819 - RNA, 21 nt, Artificial Sequence
  Description of Artificial Sequence: Synthetic oligonucleotide
  modified_base (20)..(21): 2'-methoxy-nucleotide
ugaccccaaacaccuuccauu

SEQ ID NO: 1820 - RNA, 21 nt, Artificial Sequence
  Description of Artificial Sequence: Synthetic oligonucleotide
  modified_base (20)..(21): 2'-methoxy-nucleotide
gaccccaaacaccuuccaguu

SEQ ID NO: 1821 - RNA, 21 nt, Artificial Sequence
  Description of Artificial Sequence: Synthetic oligonucleotide
  modified_base (20)..(21): 2'-methoxy-nucleotide
accccaaacaccuuccagcuu

SEQ ID NO: 1822 - RNA, 21 nt, Artificial Sequence
  Description of Artificial Sequence: Synthetic oligonucleotide
  modified_base (20)..(21): 2'-methoxy-nucleotide
ccccaaacaccuuccagcuuu

SEQ ID NO: 1823 - RNA, 21 nt, Artificial Sequence
  Description of Artificial Sequence: Synthetic oligonucleotide
  modified_base (20)..(21): 2'-methoxy-nucleotide
cccaaacaccuuccagcucuu

SEQ ID NO: 1824 - RNA, 21 nt, Artificial Sequence
  Description of Artificial Sequence: Synthetic oligonucleotide
  modified_base (20)..(21): 2'-methoxy-nucleotide
ccaaacaccuuccagcuccuu

SEQ ID NO: 1825 - RNA, 21 nt, Artificial Sequence
  Description of Artificial Sequence: Synthetic oligonucleotide
  modified_base (20)..(21): 2'-methoxy-nucleotide
caaacaccuuccagcuccuuu

SEQ ID NO: 1826 - RNA, 21 nt, Artificial Sequence
  Description of Artificial Sequence: Synthetic oligonucleotide
  modified_base (20)..(21): 2'-methoxy-nucleotide
aaacaccuuccagcuccuguu

SEQ ID NO: 1827 - RNA, 21 nt, Artificial Sequence
  Description of Artificial Sequence: Synthetic oligonucleotide
  modified_base (20)..(21): 2'-methoxy-nucleotide
aacaccuuccagcuccuguuu

SEQ ID NO: 1828 - RNA, 21 nt, Artificial Sequence
  Description of Artificial Sequence: Synthetic oligonucleotide
  modified_base (20)..(21): 2'-methoxy-nucleotide
acaccuuccagcuccuguauu

SEQ ID NO: 1829 - RNA, 21 nt, Artificial Sequence
  Description of Artificial Sequence: Synthetic oligonucleotide
  modified_base (20)..(21): 2'-methoxy-nucleotide
caccuuccagcuccuguaauu

SEQ ID NO: 1830 - RNA, 21 nt, Artificial Sequence
  Description of Artificial Sequence: Synthetic oligonucleotide
  modified_base (20)..(21): 2'-methoxy-nucleotide
accuuccagcuccuguaacuu

SEQ ID NO: 1831 - RNA, 21 nt, Artificial Sequence
  Description of Artificial Sequence: Synthetic oligonucleotide
  modified_base (20)..(21): 2'-methoxy-nucleotide
ccuuccagcuccuguaacauu

SEQ ID NO: 1832 - RNA, 21 nt, Artificial Sequence
  Description of Artificial Sequence: Synthetic oligonucleotide
  modified_base (20)..(21): 2'-methoxy-nucleotide
cuuccagcuccuguaacauuu

SEQ ID NO: 1833 - RNA, 21 nt, Artificial Sequence
  Description of Artificial Sequence: Synthetic oligonucleotide
  modified_base (20)..(21): 2'-methoxy-nucleotide
uuccagcuccuguaacauauu

SEQ ID NO: 1834 - RNA, 21 nt, Artificial Sequence
  Description of Artificial Sequence: Synthetic oligonucleotide
  modified_base (20)..(21): 2'-methoxy-nucleotide
uccagcuccuguaacauacuu

SEQ ID NO: 1835 - RNA, 21 nt, Artificial Sequence
  Description of Artificial Sequence: Synthetic oligonucleotide
  modified_base (20)..(21): 2'-methoxy-nucleotide
ccagcuccuguaacauacuuu

SEQ ID NO: 1836 - RNA, 21 nt, Artificial Sequence
  Description of Artificial Sequence: Synthetic oligonucleotide
  modified_base (20)..(21): 2'-methoxy-nucleotide
cagcuccuguaacauacuguu

SEQ ID NO: 1837 - RNA, 21 nt, Artificial Sequence
  Description of Artificial Sequence: Synthetic oligonucleotide
  modified_base (20)..(21): 2'-methoxy-nucleotide
agcuccuguaacauacugguu

SEQ ID NO: 1838 - RNA, 21 nt, Artificial Sequence
  Description of Artificial Sequence: Synthetic oligonucleotide
  modified_base (20)..(21): 2'-methoxy-nucleotide
gcuccuguaacauacuggcuu

SEQ ID NO: 1839 - RNA, 21 nt, Artificial Sequence
  Description of Artificial Sequence: Synthetic oligonucleotide
  modified_base (20)..(21): 2'-methoxy-nucleotide
cuccuguaacauacuggccuu

SEQ ID NO: 1840 - RNA, 21 nt, Artificial Sequence
  Description of Artificial Sequence: Synthetic oligonucleotide
  modified_base (20)..(21): 2'-methoxy-nucleotide
uccuguaacauacuggccuuu

SEQ ID NO: 1841 - RNA, 21 nt, Artificial Sequence
  Description of Artificial Sequence: Synthetic oligonucleotide
  modified_base (20)..(21): 2'-methoxy-nucleotide
ccuguaacauacuggccuguu

SEQ ID NO: 1842 - RNA, 21 nt, Artificial Sequence
  Description of Artificial Sequence: Synthetic oligonucleotide
  modified_base (20)..(21): 2'-methoxy-nucleotide
cuguaacauacuggccugguu

SEQ ID NO: 1843 - RNA, 21 nt, Artificial Sequence
  Description of Artificial Sequence: Synthetic oligonucleotide
  modified_base (20)..(21): 2'-methoxy-nucleotide
uguaacauacuggccuggauu

SEQ ID NO: 1844 - RNA, 21 nt, Artificial Sequence
  Description of Artificial Sequence: Synthetic oligonucleotide
  modified_base (20)..(21): 2'-methoxy-nucleotide
guaacauacuggccuggacuu

SEQ ID NO: 1845 - RNA, 21 nt, Artificial Sequence
  Description of Artificial Sequence: Synthetic oligonucleotide
  modified_base (20)..(21): 2'-methoxy-nucleotide
uaacauacuggccuggacuuu

SEQ ID NO: 1846 - RNA, 21 nt, Artificial Sequence
  Description of Artificial Sequence: Synthetic oligonucleotide
  modified_base (20)..(21): 2'-methoxy-nucleotide
aacauacuggccuggacuguu

SEQ ID NO: 1847 - RNA, 21 nt, Artificial Sequence
  Description of Artificial Sequence: Synthetic oligonucleotide
  modified_base (20)..(21): 2'-methoxy-nucleotide
acauacuggccuggacuguuu

SEQ ID NO: 1848 - RNA, 21 nt, Artificial Sequence
  Description of Artificial Sequence: Synthetic oligonucleotide
  modified_base (20)..(21): 2'-methoxy-nucleotide
cauacuggccuggacuguuuu

SEQ ID NO: 1849 - RNA, 21 nt, Artificial Sequence
  Description of Artificial Sequence: Synthetic oligonucleotide
  modified_base (20)..(21): 2'-methoxy-nucleotide
auacuggccuggacuguuuuu

SEQ ID NO: 1850 - RNA, 21 nt, Artificial Sequence
  Description of Artificial Sequence: Synthetic oligonucleotide
  modified_base (20)..(21): 2'-methoxy-nucleotide
uacuggccuggacuguuuuuu

SEQ ID NO: 1851 - RNA, 21 nt, Artificial Sequence
  Description of Artificial Sequence: Synthetic oligonucleotide
  modified_base (20)..(21): 2'-methoxy-nucleotide
acuggccuggacuguuuucuu

SEQ ID NO: 1852 - RNA, 21 nt, Artificial Sequence
  Description of Artificial Sequence: Synthetic oligonucleotide
  modified_base (20)..(21): 2'-methoxy-nucleotide
cuggccuggacuguuuucuuu

SEQ ID NO: 1853 - RNA, 21 nt, Artificial Sequence
  Description of Artificial Sequence: Synthetic oligonucleotide
  modified_base (20)..(21): 2'-methoxy-nucleotide
uggccuggacuguuuucucuu

SEQ ID NO: 1854 - RNA, 21 nt, Artificial Sequence
  Description of Artificial Sequence: Synthetic oligonucleotide
  modified_base (20)..(21): 2'-methoxy-nucleotide
ggccuggacuguuuucucuuu

SEQ ID NO: 1855 - RNA, 21 nt, Artificial Sequence
  Description of Artificial Sequence: Synthetic oligonucleotide
  modified_base (20)..(21): 2'-methoxy-nucleotide
gccuggacuguuuucucucuu

SEQ ID NO: 1856 - RNA, 21 nt, Artificial Sequence
  Description of Artificial Sequence: Synthetic oligonucleotide
  modified_base (20)..(21): 2'-methoxy-nucleotide
ccuggacuguuuucucucguu

SEQ ID NO: 1857 - RNA, 21 nt, Artificial Sequence
  Description of Artificial Sequence: Synthetic oligonucleotide
  modified_base (20)..(21): 2'-methoxy-nucleotide
cuggacuguuuucucucgguu

SEQ ID NO: 1858 - RNA, 21 nt, Artificial Sequence
  Description of Artificial Sequence: Synthetic oligonucleotide
  modified_base (20)..(21): 2'-methoxy-nucleotide
uggacuguuuucucucggcuu

SEQ ID NO: 1859 - RNA, 21 nt, Artificial Sequence
  Description of Artificial Sequence: Synthetic oligonucleotide
  modified_base (20)..(21): 2'-methoxy-nucleotide
ggacuguuuucucucggcuuu

SEQ ID NO: 1860 - RNA, 21 nt, Artificial Sequence
  Description of Artificial Sequence: Synthetic oligonucleotide
  modified_base (20)..(21): 2'-methoxy-nucleotide
gacuguuuucucucggcucuu

SEQ ID NO: 1861 - RNA, 21 nt, Artificial Sequence
  Description of Artificial Sequence: Synthetic oligonucleotide
  modified_base (20)..(21): 2'-methoxy-nucleotide
acuguuuucucucggcuccuu

SEQ ID NO: 1862 - RNA, 21 nt, Artificial Sequence
  Description of Artificial Sequence: Synthetic oligonucleotide
  modified_base (20)..(21): 2'-methoxy-nucleotide
cuguuuucucucggcucccuu

SEQ ID NO: 1863 - RNA, 21 nt, Artificial Sequence
  Description of Artificial Sequence: Synthetic oligonucleotide
  modified_base (20)..(21): 2'-methoxy-nucleotide
uguuuucucucggcuccccuu

SEQ ID NO: 1864 - RNA, 21 nt, Artificial Sequence
  Description of Artificial Sequence: Synthetic oligonucleotide
  modified_base (20)..(21): 2'-methoxy-nucleotide
guuuucucucggcuccccauu

SEQ ID NO: 1865 - RNA, 21 nt, Artificial Sequence
  Description of Artificial Sequence: Synthetic oligonucleotide
  modified_base (20)..(21): 2'-methoxy-nucleotide
uuuucucucggcuccccauuu

SEQ ID NO: 1866 - RNA, 21 nt, Artificial Sequence
  Description of Artificial Sequence: Synthetic oligonucleotide
  modified_base (20)..(21): 2'-methoxy-nucleotide
uuucucucggcuccccauguu

SEQ ID NO: 1867 - RNA, 21 nt, Artificial Sequence
  Description of Artificial Sequence: Synthetic oligonucleotide
  modified_base (20)..(21): 2'-methoxy-nucleotide
uucucucggcuccccauguuu

SEQ ID NO: 1868 - RNA, 21 nt, Artificial Sequence
  Description of Artificial Sequence: Synthetic oligonucleotide
  modified_base (20)..(21): 2'-methoxy-nucleotide
ucucucggcuccccauguguu

SEQ ID NO: 1869 - RNA, 21 nt, Artificial Sequence
  Description of Artificial Sequence: Synthetic oligonucleotide
  modified_base (20)..(21): 2'-methoxy-nucleotide
cucucggcuccccauguguuu

SEQ ID NO: 1870 - RNA, 21 nt, Artificial Sequence
  Description of Artificial Sequence: Synthetic oligonucleotide
  modified_base (20)..(21): 2'-methoxy-nucleotide
ucucggcuccccaugugucuu

SEQ ID NO: 1871 - RNA, 21 nt, Artificial Sequence
  Description of Artificial Sequence: Synthetic oligonucleotide
  modified_base (20)..(21): 2'-methoxy-nucleotide
cucggcuccccauguguccuu

SEQ ID NO: 1872 - RNA, 21 nt, Artificial Sequence
  Description of Artificial Sequence: Synthetic oligonucleotide
  modified_base (20)..(21): 2'-methoxy-nucleotide
ucggcuccccauguguccuuu

SEQ ID NO: 1873 - RNA, 21 nt, Artificial Sequence
  Description of Artificial Sequence: Synthetic oligonucleotide
  modified_base (20)..(21): 2'-methoxy-nucleotide
cggcuccccauguguccuguu

SEQ ID NO: 1874 - RNA, 21 nt, Artificial Sequence
  Description of Artificial Sequence: Synthetic oligonucleotide
  modified_base (20)..(21): 2'-methoxy-nucleotide
ggcuccccauguguccugguu

SEQ ID NO: 1875 - RNA, 21 nt, Artificial Sequence
  Description of Artificial Sequence: Synthetic oligonucleotide
  modified_base (20)..(21): 2'-methoxy-nucleotide
gcuccccauguguccugguuu

SEQ ID NO: 1876 - RNA, 21 nt, Artificial Sequence
  Description of Artificial Sequence: Synthetic oligonucleotide
  modified_base (20)..(21): 2'-methoxy-nucleotide
cuccccauguguccugguuuu

SEQ ID NO: 1877 - RNA, 21 nt, Artificial Sequence
  Description of Artificial Sequence: Synthetic oligonucleotide
  modified_base (20)..(21): 2'-methoxy-nucleotide
uccccauguguccugguucuu

SEQ ID NO: 1878 - RNA, 21 nt, Artificial Sequence
  Description of Artificial Sequence: Synthetic oligonucleotide
  modified_base (20)..(21): 2'-methoxy-nucleotide
ccccauguguccugguuccuu

SEQ ID NO: 1879 - RNA, 21 nt, Artificial Sequence
  Description of Artificial Sequence: Synthetic oligonucleotide
  modified_base (20)..(21): 2'-methoxy-nucleotide
cccauguguccugguucccuu

SEQ ID NO: 1880 - RNA, 21 nt, Artificial Sequence
  Description of Artificial Sequence: Synthetic oligonucleotide
  modified_base (20)..(21): 2'-methoxy-nucleotide
ccauguguccugguucccguu

SEQ ID NO: 1881 - RNA, 21 nt, Artificial Sequence
  Description of Artificial Sequence: Synthetic oligonucleotide
  modified_base (20)..(21): 2'-methoxy-nucleotide
cauguguccugguucccguuu

SEQ ID NO: 1882 - RNA, 21 nt, Artificial Sequence
  Description of Artificial Sequence: Synthetic oligonucleotide
  modified_base (20)..(21): 2'-methoxy-nucleotide
auguguccugguucccguuuu

SEQ ID NO: 1883 - RNA, 21 nt, Artificial Sequence
  Description of Artificial Sequence: Synthetic oligonucleotide
  modified_base (20)..(21): 2'-methoxy-nucleotide
uguguccugguucccguuuuu

SEQ ID NO: 1884 - RNA, 21 nt, Artificial Sequence
  Description of Artificial Sequence: Synthetic oligonucleotide
  modified_base (20)..(21): 2'-methoxy-nucleotide
guguccugguucccguuucuu

SEQ ID NO: 1885 - RNA, 21 nt, Artificial Sequence
  Description of Artificial Sequence: Synthetic oligonucleotide
  modified_base (20)..(21): 2'-methoxy-nucleotide
uguccugguucccguuucuuu

SEQ ID NO: 1886 - RNA, 21 nt, Artificial Sequence
  Description of Artificial Sequence: Synthetic oligonucleotide
  modified_base (20)..(21): 2'-methoxy-nucleotide
guccugguucccguuucucuu

SEQ ID NO: 1887 - RNA, 21 nt, Artificial Sequence
  Description of Artificial Sequence: Synthetic oligonucleotide
  modified_base (20)..(21): 2'-methoxy-nucleotide
uccugguucccguuucuccuu

SEQ ID NO: 1888 - RNA, 21 nt, Artificial Sequence
  Description of Artificial Sequence: Synthetic oligonucleotide
  modified_base (20)..(21): 2'-methoxy-nucleotide
ccugguucccguuucuccauu

SEQ ID NO: 1889 - RNA, 21 nt, Artificial Sequence
  Description of Artificial Sequence: Synthetic oligonucleotide
  modified_base (20)..(21): 2'-methoxy-nucleotide
cugguucccguuucuccacuu

SEQ ID NO: 1890 - RNA, 21 nt, Artificial Sequence
  Description of Artificial Sequence: Synthetic oligonucleotide
  modified_base (20)..(21): 2'-methoxy-nucleotide
ugguucccguuucuccaccuu

SEQ ID NO: 1891 - RNA, 21 nt, Artificial Sequence
  Description of Artificial Sequence: Synthetic oligonucleotide
  modified_base (20)..(21): 2'-methoxy-nucleotide
gguucccguuucuccaccuuu

SEQ ID NO: 1892 - RNA, 21 nt, Artificial Sequence
  Description of Artificial Sequence: Synthetic oligonucleotide
  modified_base (20)..(21): 2'-methoxy-nucleotide
guucccguuucuccaccuauu

SEQ ID NO: 1893 - RNA, 21 nt, Artificial Sequence
  Description of Artificial Sequence: Synthetic oligonucleotide
  modified_base (20)..(21): 2'-methoxy-nucleotide
uucccguuucuccaccuaguu

SEQ ID NO: 1894 - RNA, 21 nt, Artificial Sequence
  Description of Artificial Sequence: Synthetic oligonucleotide
  modified_base (20)..(21): 2'-methoxy-nucleotide
ucccguuucuccaccuagauu

SEQ ID NO: 1895 - RNA, 21 nt, Artificial Sequence
  Description of Artificial Sequence: Synthetic oligonucleotide
  modified_base (20)..(21): 2'-methoxy-nucleotide
cccguuucuccaccuagacuu

SEQ ID NO: 1896 - RNA, 21 nt, Artificial Sequence
  Description of Artificial Sequence: Synthetic oligonucleotide
  modified_base (20)..(21): 2'-methoxy-nucleotide
ccguuucuccaccuagacuuu

SEQ ID NO: 1897 - RNA, 21 nt, Artificial Sequence
  Description of Artificial Sequence: Synthetic oligonucleotide
  modified_base (20)..(21): 2'-methoxy-nucleotide
cguuucuccaccuagacuguu

SEQ ID NO: 1898 - RNA, 21 nt, Artificial Sequence
  Description of Artificial Sequence: Synthetic oligonucleotide
  modified_base (20)..(21): 2'-methoxy-nucleotide
guuucuccaccuagacuguuu

SEQ ID NO: 1899 - RNA, 21 nt, Artificial Sequence
  Description of Artificial Sequence: Synthetic oligonucleotide
  modified_base (20)..(21): 2'-methoxy-nucleotide
uuucuccaccuagacuguauu

SEQ ID NO: 1900 - RNA, 21 nt, Artificial Sequence
  Description of Artificial Sequence: Synthetic oligonucleotide
  modified_base (20)..(21): 2'-methoxy-nucleotide
uucuccaccuagacuguaauu

SEQ ID NO: 1901 - RNA, 21 nt, Artificial Sequence
  Description of Artificial Sequence: Synthetic oligonucleotide
  modified_base (20)..(21): 2'-methoxy-nucleotide
ucuccaccuagacuguaaauu

SEQ ID NO: 1902 - RNA, 21 nt, Artificial Sequence
  Description of Artificial Sequence: Synthetic oligonucleotide
  modified_base (20)..(21): 2'-methoxy-nucleotide
cuccaccuagacuguaaacuu

SEQ ID NO: 1903 - RNA, 21 nt, Artificial Sequence
  Description of Artificial Sequence: Synthetic oligonucleotide
  modified_base (20)..(21): 2'-methoxy-nucleotide
uccaccuagacuguaaaccuu

SEQ ID NO: 1904 - RNA, 21 nt, Artificial Sequence
  Description of Artificial Sequence: Synthetic oligonucleotide
  modified_base (20)..(21): 2'-methoxy-nucleotide
ccaccuagacuguaaaccuuu

SEQ ID NO: 1905 - RNA, 21 nt, Artificial Sequence
  Description of Artificial Sequence: Synthetic oligonucleotide
  modified_base (20)..(21): 2'-methoxy-nucleotide
caccuagacuguaaaccucuu

SEQ ID NO: 1906 - RNA, 21 nt, Artificial Sequence
  Description of Artificial Sequence: Synthetic oligonucleotide
  modified_base (20)..(21): 2'-methoxy-nucleotide
accuagacuguaaaccucuuu

SEQ ID NO: 1907 - RNA, 21 nt, Artificial Sequence
  Description of Artificial Sequence: Synthetic oligonucleotide
  modified_base (20)..(21): 2'-methoxy-nucleotide
ccuagacuguaaaccucucuu

SEQ ID NO: 1908 - RNA, 21 nt, Artificial Sequence
  Description of Artificial Sequence: Synthetic oligonucleotide
  modified_base (20)..(21): 2'-methoxy-nucleotide
cuagacuguaaaccucucguu

SEQ ID NO: 1909 - RNA, 21 nt, Artificial Sequence
  Description of Artificial Sequence: Synthetic oligonucleotide
  modified_base (20)..(21): 2'-methoxy-nucleotide
uagacuguaaaccucucgauu

SEQ ID NO: 1910 - RNA, 21 nt, Artificial Sequence
  Description of Artificial Sequence: Synthetic oligonucleotide
  modified_base (20)..(21): 2'-methoxy-nucleotide
agacuguaaaccucucgaguu

SEQ ID NO: 1911 - RNA, 21 nt, Artificial Sequence
  Description of Artificial Sequence: Synthetic oligonucleotide
  modified_base (20)..(21): 2'-methoxy-nucleotide
gacuguaaaccucucgagguu

SEQ ID NO: 1912 - RNA, 21 nt, Artificial Sequence
  Description of Artificial Sequence: Synthetic oligonucleotide
  modified_base (20)..(21): 2'-methoxy-nucleotide
acuguaaaccucucgaggguu

SEQ ID NO: 1913 - RNA, 21 nt, Artificial Sequence
  Description of Artificial Sequence: Synthetic oligonucleotide
  modified_base (20)..(21): 2'-methoxy-nucleotide
cuguaaaccucucgagggcuu

SEQ ID NO: 1914 - RNA, 21 nt, Artificial Sequence
  Description of Artificial Sequence: Synthetic oligonucleotide
  modified_base (20)..(21): 2'-methoxy-nucleotide
uguaaaccucucgagggcauu

SEQ ID NO: 1915 - RNA, 21 nt, Artificial Sequence
  Description of Artificial Sequence: Synthetic oligonucleotide
  modified_base (20)..(21): 2'-methoxy-nucleotide
guaaaccucucgagggcaguu

SEQ ID NO: 1916 - RNA, 21 nt, Artificial Sequence
  Description of Artificial Sequence: Synthetic oligonucleotide
  modified_base (20)..(21): 2'-methoxy-nucleotide
uaaaccucucgagggcagguu

SEQ ID NO: 1917 - RNA, 21 nt, Artificial Sequence
  Description of Artificial Sequence: Synthetic oligonucleotide
  modified_base (20)..(21): 2'-methoxy-nucleotide
aaaccucucgagggcaggguu

SEQ ID NO: 1918 - RNA, 21 nt, Artificial Sequence
  Description of Artificial Sequence: Synthetic oligonucleotide
  modified_base (20)..(21): 2'-methoxy-nucleotide
aaccucucgagggcagggauu

SEQ ID NO: 1919 - RNA, 21 nt, Artificial Sequence
  Description of Artificial Sequence: Synthetic oligonucleotide
  modified_base (20)..(21): 2'-methoxy-nucleotide
accucucgagggcagggacuu

SEQ ID NO: 1920 - RNA, 21 nt, Artificial Sequence
  Description of Artificial Sequence: Synthetic oligonucleotide
  modified_base (20)..(21): 2'-methoxy-nucleotide
ccucucgagggcagggaccuu

SEQ ID NO: 1921 - RNA, 21 nt, Artificial Sequence
  Description of Artificial Sequence: Synthetic oligonucleotide
  modified_base (20)..(21): 2'-methoxy-nucleotide
cucucgagggcagggaccauu

SEQ ID NO: 1922 - RNA, 21 nt, Artificial Sequence
  Description of Artificial Sequence: Synthetic oligonucleotide
  modified_base (20)..(21): 2'-methoxy-nucleotide
ucucgagggcagggaccacuu

SEQ ID NO: 1923 - RNA, 21 nt, Artificial Sequence
  Description of Artificial Sequence: Synthetic oligonucleotide
  modified_base (20)..(21): 2'-methoxy-nucleotide
cucgagggcagggaccacauu

SEQ ID NO: 1924 - RNA, 21 nt, Artificial Sequence
  Description of Artificial Sequence: Synthetic oligonucleotide
  modified_base (20)..(21): 2'-methoxy-nucleotide
ucgagggcagggaccacacuu

SEQ ID NO: 1925 - RNA, 21 nt, Artificial Sequence
  Description of Artificial Sequence: Synthetic oligonucleotide
  modified_base (20)..(21): 2'-methoxy-nucleotide
cgagggcagggaccacaccuu

SEQ ID NO: 1926 - RNA, 21 nt, Artificial Sequence
  Description of Artificial Sequence: Synthetic oligonucleotide
  modified_base (20)..(21): 2'-methoxy-nucleotide
gagggcagggaccacacccuu

SEQ ID NO: 1927 - RNA, 21 nt, Artificial Sequence
  Description of Artificial Sequence: Synthetic oligonucleotide
  modified_base (20)..(21): 2'-methoxy-nucleotide
agggcagggaccacacccuuu

SEQ ID NO: 1928 - RNA, 21 nt, Artificial Sequence
  Description of Artificial Sequence: Synthetic oligonucleotide
  modified_base (20)..(21): 2'-methoxy-nucleotide
gggcagggaccacacccuguu

SEQ ID NO: 1929 - RNA, 21 nt, Artificial Sequence
  Description of Artificial Sequence: Synthetic oligonucleotide
  modified_base (20)..(21): 2'-methoxy-nucleotide
ggcagggaccacacccuguuu

SEQ ID NO: 1930 - RNA, 21 nt, Artificial Sequence
  Description of Artificial Sequence: Synthetic oligonucleotide
  modified_base (20)..(21): 2'-methoxy-nucleotide
gcagggaccacacccuguauu

SEQ ID NO: 1931 - RNA, 21 nt, Artificial Sequence
  Description of Artificial Sequence: Synthetic oligonucleotide
  modified_base (20)..(21): 2'-methoxy-nucleotide
cagggaccacacccuguacuu

SEQ ID NO: 1932 - RNA, 21 nt, Artificial Sequence
  Description of Artificial Sequence: Synthetic oligonucleotide
  modified_base (20)..(21): 2'-methoxy-nucleotide
agggaccacacccuguacuuu

SEQ ID NO: 1933 - RNA, 21 nt, Artificial Sequence
  Description of Artificial Sequence: Synthetic oligonucleotide
  modified_base (20)..(21): 2'-methoxy-nucleotide
gggaccacacccuguacuguu

SEQ ID NO: 1934 - RNA, 21 nt, Artificial Sequence
  Description of Artificial Sequence: Synthetic oligonucleotide
  modified_base (20)..(21): 2'-methoxy-nucleotide
ggaccacacccuguacuguuu

SEQ ID NO: 1935 - RNA, 21 nt, Artificial Sequence
  Description of Artificial Sequence: Synthetic oligonucleotide
  modified_base (20)..(21): 2'-methoxy-nucleotide
gaccacacccuguacuguuuu

SEQ ID NO: 1936 - RNA, 21 nt, Artificial Sequence
  Description of Artificial Sequence: Synthetic oligonucleotide
  modified_base (20)..(21): 2'-methoxy-nucleotide
accacacccuguacuguucuu

SEQ ID NO: 1937 - RNA, 21 nt, Artificial Sequence
  Description of Artificial Sequence: Synthetic oligonucleotide
  modified_base (20)..(21): 2'-methoxy-nucleotide
ccacacccuguacuguucuuu

SEQ ID NO: 1938 - RNA, 21 nt, Artificial Sequence
  Description of Artificial Sequence: Synthetic oligonucleotide
  modified_base (20)..(21): 2'-methoxy-nucleotide
cacacccuguacuguucuguu

SEQ ID NO: 1939 - RNA, 21 nt, Artificial Sequence
  Description of Artificial Sequence: Synthetic oligonucleotide
  modified_base (20)..(21): 2'-methoxy-nucleotide
acacccuguacuguucuguuu

SEQ ID NO: 1940 - RNA, 21 nt, Artificial Sequence
  Description of Artificial Sequence: Synthetic oligonucleotide
  modified_base (20)..(21): 2'-methoxy-nucleotide
cacccuguacuguucuguguu

SEQ ID NO: 1941 - RNA, 21 nt, Artificial Sequence
  Description of Artificial Sequence: Synthetic oligonucleotide
  modified_base (20)..(21): 2'-methoxy-nucleotide
acccuguacuguucuguguuu

SEQ ID NO: 1942 - RNA, 21 nt, Artificial Sequence
  Description of Artificial Sequence: Synthetic oligonucleotide
  modified_base (20)..(21): 2'-methoxy-nucleotide
cccuguacuguucugugucuu

SEQ ID NO: 1943 - RNA, 21 nt, Artificial Sequence
  Description of Artificial Sequence: Synthetic oligonucleotide
  modified_base (20)..(21): 2'-methoxy-nucleotide
ccuguacuguucugugucuuu

SEQ ID NO: 1944 - RNA, 21 nt, Artificial Sequence
  Description of Artificial Sequence: Synthetic oligonucleotide
  modified_base (20)..(21): 2'-methoxy-nucleotide
cuguacuguucugugucuuuu

SEQ ID NO: 1945 - RNA, 21 nt, Artificial Sequence
  Description of Artificial Sequence: Synthetic oligonucleotide
  modified_base (20)..(21): 2'-methoxy-nucleotide
uguacuguucugugucuuuuu

SEQ ID NO: 1946 - RNA, 21 nt, Artificial Sequence
  Description of Artificial Sequence: Synthetic oligonucleotide
  modified_base (20)..(21): 2'-methoxy-nucleotide
guacuguucugugucuuucuu

SEQ ID NO: 1947 - RNA, 21 nt, Artificial Sequence
  Description of Artificial Sequence: Synthetic oligonucleotide
  modified_base (20)..(21): 2'-methoxy-nucleotide
uacuguucugugucuuucauu

SEQ ID NO: 1948 - RNA, 21 nt, Artificial Sequence
  Description of Artificial Sequence: Synthetic oligonucleotide
  modified_base (20)..(21): 2'-methoxy-nucleotide
acuguucugugucuuucacuu

SEQ ID NO: 1949 - RNA, 21 nt, Artificial Sequence
  Description of Artificial Sequence: Synthetic oligonucleotide
  modified_base (20)..(21): 2'-methoxy-nucleotide
cuguucugugucuuucacauu

SEQ ID NO: 1950 - RNA, 21 nt, Artificial Sequence
  Description of Artificial Sequence: Synthetic oligonucleotide
  modified_base (20)..(21): 2'-methoxy-nucleotide
uguucugugucuuucacaguu

SEQ ID NO: 1951 - RNA, 21 nt, Artificial Sequence
  Description of Artificial Sequence: Synthetic oligonucleotide
  modified_base (20)..(21): 2'-methoxy-nucleotide
guucugugucuuucacagcuu

SEQ ID NO: 1952 - RNA, 21 nt, Artificial Sequence
  Description of Artificial Sequence: Synthetic oligonucleotide
  modified_base (20)..(21): 2'-methoxy-nucleotide
uucugugucuuucacagcuuu

SEQ ID NO: 1953 - RNA, 21 nt, Artificial Sequence
  Description of Artificial Sequence: Synthetic oligonucleotide
  modified_base (20)..(21): 2'-methoxy-nucleotide
ucugugucuuucacagcucuu

SEQ ID NO: 1954 - RNA, 21 nt, Artificial Sequence
  Description of Artificial Sequence: Synthetic oligonucleotide
  modified_base (20)..(21): 2'-methoxy-nucleotide
cugugucuuucacagcuccuu

SEQ ID NO: 1955 - RNA, 21 nt, Artificial Sequence
  Description of Artificial Sequence: Synthetic oligonucleotide
  modified_base (20)..(21): 2'-methoxy-nucleotide
ugugucuuucacagcuccuuu

SEQ ID NO: 1956 - RNA, 21 nt, Artificial Sequence
  Description of Artificial Sequence: Synthetic oligonucleotide
  modified_base (20)..(21): 2'-methoxy-nucleotide
gugucuuucacagcuccucuu

SEQ ID NO: 1957 - RNA, 21 nt, Artificial Sequence
  Description of Artificial Sequence: Synthetic oligonucleotide
  modified_base (20)..(21): 2'-methoxy-nucleotide
ugucuuucacagcuccuccuu

SEQ ID NO: 1958 - RNA, 21 nt, Artificial Sequence
  Description of Artificial Sequence: Synthetic oligonucleotide
  modified_base (20)..(21): 2'-methoxy-nucleotide
gucuuucacagcuccucccuu

SEQ ID NO: 1959 - RNA, 21 nt, Artificial Sequence
  Description of Artificial Sequence: Synthetic oligonucleotide
  modified_base (20)..(21): 2'-methoxy-nucleotide
ucuuucacagcuccucccauu

SEQ ID NO: 1960 - RNA, 21 nt, Artificial Sequence
  Description of Artificial Sequence: Synthetic oligonucleotide
  modified_base (20)..(21): 2'-methoxy-nucleotide
cuuucacagcuccucccacuu

SEQ ID NO: 1961 - RNA, 21 nt, Artificial Sequence
  Description of Artificial Sequence: Synthetic oligonucleotide
  modified_base (20)..(21): 2'-methoxy-nucleotide
uuucacagcuccucccacauu

SEQ ID NO: 1962 - RNA, 21 nt, Artificial Sequence
  Description of Artificial Sequence: Synthetic oligonucleotide
  modified_base (20)..(21): 2'-methoxy-nucleotide
uucacagcuccucccacaauu

SEQ ID NO: 1963 - RNA, 21 nt, Artificial Sequence
  Description of Artificial Sequence: Synthetic oligonucleotide
  modified_base (20)..(21): 2'-methoxy-nucleotide
ucacagcuccucccacaauuu

SEQ ID NO: 1964 - RNA, 21 nt, Artificial Sequence
  Description of Artificial Sequence: Synthetic oligonucleotide
  modified_base (20)..(21): 2'-methoxy-nucleotide
cacagcuccucccacaauguu

SEQ ID NO: 1965 - RNA, 21 nt, Artificial Sequence
  Description of Artificial Sequence: Synthetic oligonucleotide
  modified_base (20)..(21): 2'-methoxy-nucleotide
acagcuccucccacaaugcuu

SEQ ID NO: 1966 - RNA, 21 nt, Artificial Sequence
  Description of Artificial Sequence: Synthetic oligonucleotide
  modified_base (20)..(21): 2'-methoxy-nucleotide
cagcuccucccacaaugcuuu

SEQ ID NO: 1967 - RNA, 21 nt, Artificial Sequence
  Description of Artificial Sequence: Synthetic oligonucleotide
  modified_base (20)..(21): 2'-methoxy-nucleotide
agcuccucccacaaugcuguu

SEQ ID NO: 1968 - RNA, 21 nt, Artificial Sequence
  Description of Artificial Sequence: Synthetic oligonucleotide
  modified_base (20)..(21): 2'-methoxy-nucleotide
gcuccucccacaaugcugauu

SEQ ID NO: 1969 - RNA, 21 nt, Artificial Sequence
  Description of Artificial Sequence: Synthetic oligonucleotide
  modified_base (20)..(21): 2'-methoxy-nucleotide
cuccucccacaaugcugaauu

SEQ ID NO: 1970 - RNA, 21 nt, Artificial Sequence
  Description of Artificial Sequence: Synthetic oligonucleotide
  modified_base (20)..(21): 2'-methoxy-nucleotide
uccucccacaaugcugaauuu

SEQ ID NO: 1971 - RNA, 21 nt, Artificial Sequence
  Description of Artificial Sequence: Synthetic oligonucleotide
  modified_base (20)..(21): 2'-methoxy-nucleotide
ccucccacaaugcugaauauu

SEQ ID NO: 1972 - RNA, 21 nt, Artificial Sequence
  Description of Artificial Sequence: Synthetic oligonucleotide
  modified_base (20)..(21): 2'-methoxy-nucleotide
cucccacaaugcugaauauuu

SEQ ID NO: 1973 - RNA, 21 nt, Artificial Sequence
  Description of Artificial Sequence: Synthetic oligonucleotide
  modified_base (20)..(21): 2'-methoxy-nucleotide
ucccacaaugcugaauauauu

SEQ ID NO: 1974 - RNA, 21 nt, Artificial Sequence
  Description of Artificial Sequence: Synthetic oligonucleotide
  modified_base (20)..(21): 2'-methoxy-nucleotide
cccacaaugcugaauauacuu

SEQ ID NO: 1975 - RNA, 21 nt, Artificial Sequence
  Description of Artificial Sequence: Synthetic oligonucleotide
  modified_base (20)..(21): 2'-methoxy-nucleotide
ccacaaugcugaauauacauu

SEQ ID NO: 1976 - RNA, 21 nt, Artificial Sequence
  Description of Artificial Sequence: Synthetic oligonucleotide
  modified_base (20)..(21): 2'-methoxy-nucleotide
cacaaugcugaauauacaguu

SEQ ID NO: 1977 - RNA, 21 nt, Artificial Sequence
  Description of Artificial Sequence: Synthetic oligonucleotide
  modified_base (20)..(21): 2'-methoxy-nucleotide
acaaugcugaauauacagcuu

SEQ ID NO: 1978 - RNA, 21 nt, Artificial Sequence
  Description of Artificial Sequence: Synthetic oligonucleotide
  modified_base (20)..(21): 2'-methoxy-nucleotide
caaugcugaauauacagcauu

SEQ ID NO: 1979 - RNA, 21 nt, Artificial Sequence
  Description of Artificial Sequence: Synthetic oligonucleotide
  modified_base (20)..(21): 2'-methoxy-nucleotide
aaugcugaauauacagcaguu

SEQ ID NO: 1980 - RNA, 21 nt, Artificial Sequence
  Description of Artificial Sequence: Synthetic oligonucleotide
  modified_base (20)..(21): 2'-methoxy-nucleotide
augcugaauauacagcagguu

SEQ ID NO: 1981 - RNA, 21 nt, Artificial Sequence
  Description of Artificial Sequence: Synthetic oligonucleotide
  modified_base (20)..(21): 2'-methoxy-nucleotide
ugcugaauauacagcagguuu

SEQ ID NO: 1982 - RNA, 21 nt, Artificial Sequence
  Description of Artificial Sequence: Synthetic oligonucleotide
  modified_base (20)..(21): 2'-methoxy-nucleotide
gcugaauauacagcagguguu

SEQ ID NO: 1983 - RNA, 21 nt, Artificial Sequence
  Description of Artificial Sequence: Synthetic oligonucleotide
  modified_base (20)..(21): 2'-methoxy-nucleotide
cugaauauacagcaggugcuu

SEQ ID NO: 1984 - RNA, 21 nt, Artificial Sequence
  Description of Artificial Sequence: Synthetic oligonucleotide
  modified_base (20)..(21): 2'-methoxy-nucleotide
ugaauauacagcaggugcuuu

SEQ ID NO: 1985 - RNA, 21 nt, Artificial Sequence
  Description of Artificial Sequence: Synthetic oligonucleotide
  modified_base (20)..(21): 2'-methoxy-nucleotide
gaauauacagcaggugcucuu

SEQ ID NO: 1986 - RNA, 21 nt, Artificial Sequence
  Description of Artificial Sequence: Synthetic oligonucleotide
  modified_base (20)..(21): 2'-methoxy-nucleotide
aauauacagcaggugcucauu

SEQ ID NO: 1987 - RNA, 21 nt, Artificial Sequence
  Description of Artificial Sequence: Synthetic oligonucleotide
  modified_base (20)..(21): 2'-methoxy-nucleotide
auauacagcaggugcucaauu

SEQ ID NO: 1988 - RNA, 21 nt, Artificial Sequence
  Description of Artificial Sequence: Synthetic oligonucleotide
  modified_base (20)..(21): 2'-methoxy-nucleotide
uauacagcaggugcucaauuu

SEQ ID NO: 1989 - RNA, 21 nt, Artificial Sequence
  Description of Artificial Sequence: Synthetic oligonucleotide
  modified_base (20)..(21): 2'-methoxy-nucleotide
auacagcaggugcucaauauu

SEQ ID NO: 1990 - RNA, 21 nt, Artificial Sequence
  Description of Artificial Sequence: Synthetic oligonucleotide
  modified_base (20)..(21): 2'-methoxy-nucleotide
uacagcaggugcucaauaauu

SEQ ID NO: 1991 - RNA, 21 nt, Artificial Sequence
  Description of Artificial Sequence: Synthetic oligonucleotide
  modified_base (20)..(21): 2'-methoxy-nucleotide
acagcaggugcucaauaaauu

SEQ ID NO: 1992 - RNA, 21 nt, Artificial Sequence
  Description of Artificial Sequence: Synthetic oligonucleotide
  modified_base (20)..(21): 2'-methoxy-nucleotide
cagcaggugcucaauaaauuu

SEQ ID NO: 1993 - RNA, 21 nt, Artificial Sequence
  Description of Artificial Sequence: Synthetic oligonucleotide
  modified_base (20)..(21): 2'-methoxy-nucleotide
agcaggugcucaauaaauguu

SEQ ID NO: 1994 - RNA, 21 nt, Artificial Sequence
  Description of Artificial Sequence: Synthetic oligonucleotide
  modified_base (20)..(21): 2'-methoxy-nucleotide
gcaggugcucaauaaaugauu

SEQ ID NO: 1995 - RNA, 21 nt, Artificial Sequence
  Description of Artificial Sequence: Synthetic oligonucleotide
  modified_base (20)..(21): 2'-methoxy-nucleotide
caggugcucaauaaaugauuu

SEQ ID NO: 1996 - RNA, 21 nt, Artificial Sequence
  Description of Artificial Sequence: Synthetic oligonucleotide
  modified_base (20)..(21): 2'-methoxy-nucleotide
aggugcucaauaaaugauuuu

SEQ ID NO: 1997 - RNA, 21 nt, Artificial Sequence
  Description of Artificial Sequence: Synthetic oligonucleotide
  modified_base (20)..(21): 2'-methoxy-nucleotide
ggugcucaauaaaugauucuu

SEQ ID NO: 1998 - RNA, 21 nt, Artificial Sequence
  Description of Artificial Sequence: Synthetic oligonucleotide
  modified_base (20)..(21): 2'-methoxy-nucleotide
gugcucaauaaaugauucuuu

SEQ ID NO: 1999 - RNA, 21 nt, Artificial Sequence
  Description of Artificial Sequence: Synthetic oligonucleotide
  modified_base (20)..(21): 2'-methoxy-nucleotide
ugcucaauaaaugauucuuuu

SEQ ID NO: 2000 - RNA, 21 nt, Artificial Sequence
  Description of Artificial Sequence: Synthetic oligonucleotide
  modified_base (20)..(21): 2'-methoxy-nucleotide
gcucaauaaaugauucuuauu

SEQ ID NO: 2001 - RNA, 21 nt, Artificial Sequence
  Description of Artificial Sequence: Synthetic oligonucleotide
  modified_base (20)..(21): 2'-methoxy-nucleotide
cucaauaaaugauucuuaguu

SEQ ID NO: 2002 - RNA, 21 nt, Artificial Sequence
  Description of Artificial Sequence: Synthetic oligonucleotide
  modified_base (20)..(21): 2'-methoxy-nucleotide
ucaauaaaugauucuuaguuu

SEQ ID NO: 2003 - RNA, 21 nt, Artificial Sequence
  Description of Artificial Sequence: Synthetic oligonucleotide
  modified_base (20)..(21): 2'-methoxy-nucleotide
caauaaaugauucuuaguguu

SEQ ID NO: 2004 - RNA, 21 nt, Artificial Sequence
  Description of Artificial Sequence: Synthetic oligonucleotide
  modified_base (20)..(21): 2'-methoxy-nucleotide
aauaaaugauucuuagugauu

SEQ ID NO: 2005 - RNA, 21 nt, Artificial Sequence
  Description of Artificial Sequence: Synthetic oligonucleotide
  modified_base (20)..(21): 2'-methoxy-nucleotide
auaaaugauucuuagugacuu

SEQ ID NO: 2006 - RNA, 21 nt, Artificial Sequence
  Description of Artificial Sequence: Synthetic oligonucleotide
  modified_base (20)..(21): 2'-methoxy-nucleotide
uaaaugauucuuagugacuuu

SEQ ID NO: 2007 - RNA, 21 nt, Artificial Sequence
  Description of Artificial Sequence: Synthetic oligonucleotide
  modified_base (20)..(21): 2'-methoxy-nucleotide
aaaugauucuuagugacuuuu

SEQ ID NO: 2008 - RNA, 21 nt, Artificial Sequence
  Description of Artificial Sequence: Synthetic oligonucleotide
  modified_base (20)..(21): 2'-methoxy-nucleotide
aaugauucuuagugacuuuuu

SEQ ID NO: 2009 - RNA, 21 nt, Artificial Sequence
  Description of Artificial Sequence: Synthetic oligonucleotide
  modified_base (20)..(21): 2'-methoxy-nucleotide
augauucuuagugacuuuauu

SEQ ID NO: 2010 - RNA, 21 nt, Artificial Sequence
  Description of Artificial Sequence: Synthetic oligonucleotide
  modified_base (20)..(21): 2'-methoxy-nucleotide
ugauucuuagugacuuuacuu

SEQ ID NO: 2011 - RNA, 21 nt, Artificial Sequence
  Description of Artificial Sequence: Synthetic oligonucleotide
  modified_base (20)..(21): 2'-methoxy-nucleotide
gauucuuagugacuuuacuuu

SEQ ID NO: 2012 - RNA, 21 nt, Artificial Sequence
  Description of Artificial Sequence: Synthetic oligonucleotide
  modified_base (20)..(21): 2'-methoxy-nucleotide
auucuuagugacuuuacuuuu

SEQ ID NO: 2013 - RNA, 21 nt, Artificial Sequence
  Description of Artificial Sequence: Synthetic oligonucleotide
  modified_base (20)..(21): 2'-methoxy-nucleotide
uucuuagugacuuuacuuguu

SEQ ID NO: 2014 - RNA, 21 nt, Artificial Sequence
  Description of Artificial Sequence: Synthetic oligonucleotide
  modified_base (20)..(21): 2'-methoxy-nucleotide
ucuuagugacuuuacuuguuu

SEQ ID NO: 2015 - RNA, 21 nt, Artificial Sequence
  Description of Artificial Sequence: Synthetic oligonucleotide
  modified_base (20)..(21): 2'-methoxy-nucleotide
cuuagugacuuuacuuguauu

SEQ ID NO: 2016 - RNA, 21 nt, Artificial Sequence
  Description of Artificial Sequence: Synthetic oligonucleotide
  modified_base (20)..(21): 2'-methoxy-nucleotide
uuagugacuuuacuuguaauu

SEQ ID NO: 2017 - RNA, 21 nt, Artificial Sequence
  Description of Artificial Sequence: Synthetic oligonucleotide
  modified_base (20)..(21): 2'-methoxy-nucleotide
uagugacuuuacuuguaaauu

SEQ ID NO: 2018 - RNA, 21 nt, Artificial Sequence
  Description of Artificial Sequence: Synthetic oligonucleotide
  modified_base (20)..(21): 2'-methoxy-nucleotide
agugacuuuacuuguaaaauu

SEQ ID NO: 2019 - RNA, 21 nt, Artificial Sequence
  Description of Artificial Sequence: Synthetic oligonucleotide
  modified_base (20)..(21): 2'-methoxy-nucleotide
gugacuuuacuuguaaaaauu

SEQ ID NO: 2020 - RNA, 21 nt, Artificial Sequence
  Description of Artificial Sequence: Synthetic oligonucleotide
  modified_base (20)..(21): 2'-methoxy-nucleotide
ugacuuuacuuguaaaaaauu

SEQ ID NO: 2021 - RNA, 21 nt, Artificial Sequence
  Description of Artificial Sequence: Synthetic oligonucleotide
  modified_base (20)..(21): 2'-methoxy-nucleotide
gacuuuacuuguaaaaaaauu

SEQ ID NO: 2022 - RNA, 21 nt, Artificial Sequence
  Description of Artificial Sequence: Synthetic oligonucleotide
  modified_base (20)..(21): 2'-methoxy-nucleotide
acuuuacuuguaaaaaaaauu

SEQ ID NO: 2023 - RNA, 21 nt, Artificial Sequence
  Description of Artificial Sequence: Synthetic oligonucleotide
  modified_base (20)..(21): 2'-methoxy-nucleotide
cuuuacuuguaaaaaaaaauu

SEQ ID NO: 2024 - RNA, 21 nt, Artificial Sequence
  Description of Artificial Sequence: Synthetic oligonucleotide
  modified_base (20)..(21): 2'-methoxy-nucleotide
uuuacuuguaaaaaaaaaauu

SEQ ID NO: 2025 - RNA, 21 nt, Artificial Sequence
  Description of Artificial Sequence: Synthetic oligonucleotide
  modified_base (20)..(21): 2'-methoxy-nucleotide
uuacuuguaaaaaaaaaaauu

SEQ ID NO: 2026 - RNA, 21 nt, Artificial Sequence
  Description of Artificial Sequence: Synthetic oligonucleotide
  modified_base (20)..(21): 2'-methoxy-nucleotide
uacuuguaaaaaaaaaaaauu

SEQ ID NO: 2027 - RNA, 21 nt, Artificial Sequence
  Description of Artificial Sequence: Synthetic oligonucleotide
  modified_base (20)..(21): 2'-methoxy-nucleotide
acuuguaaaaaaaaaaaaauu

SEQ ID NO: 2028 - RNA, 21 nt, Artificial Sequence
  Description of Artificial Sequence: Synthetic oligonucleotide
  modified_base (20)..(21): 2'-methoxy-nucleotide
cuuguaaaaaaaaaaaaaauu

SEQ ID NO: 2029 - RNA, 21 nt, Artificial Sequence
  Description of Artificial Sequence: Synthetic oligonucleotide
  modified_base (20)..(21): 2'-methoxy-nucleotide
uuguaaaaaaaaaaaaaaauu

SEQ ID NO: 2030 - RNA, 21 nt, Artificial Sequence
  Description of Artificial Sequence: Synthetic oligonucleotide
  modified_base (20)..(21): 2'-methoxy-nucleotide
uguaaaaaaaaaaaaaaaauu

SEQ ID NO: 2031 - RNA, 21 nt, Artificial Sequence
  Description of Artificial Sequence: Synthetic oligonucleotide
  modified_base (20)..(21): 2'-methoxy-nucleotide
guaaaaaaaaaaaaaaaaauu

SEQ ID NO: 2032 - RNA, 21 nt, Artificial Sequence
  Description of Artificial Sequence: Synthetic oligonucleotide
  modified_base (20)..(21): 2'-methoxy-nucleotide
uaaaaaaaaaaaaaaaaaauu

SEQ ID NO: 2033 - RNA, 21 nt, Artificial Sequence
  Description of Artificial Sequence: Synthetic oligonucleotide
  modified_base (20)..(21): 2'-methoxy-nucleotide
ccccagccgguucugacauuu

SEQ ID NO: 2034 - RNA, 21 nt, Artificial Sequence
  Description of Artificial Sequence: Synthetic oligonucleotide
  modified_base (20)..(21): 2'-methoxy-nucleotide
uccccagccgguucugacauu

SEQ ID NO: 2035 - RNA, 21 nt, Artificial Sequence
  Description of Artificial Sequence: Synthetic oligonucleotide
  modified_base (20)..(21): 2'-methoxy-nucleotide
auccccagccgguucugacuu

SEQ ID NO: 2036 - RNA, 21 nt, Artificial Sequence
  Description of Artificial Sequence: Synthetic oligonucleotide
  modified_base (20)..(21): 2'-methoxy-nucleotide
cauccccagccgguucugauu

SEQ ID NO: 2037 - RNA, 21 nt, Artificial Sequence
  Description of Artificial Sequence: Synthetic oligonucleotide
  modified_base (20)..(21): 2'-methoxy-nucleotide
acauccccagccgguucuguu

SEQ ID NO: 2038 - RNA, 21 nt, Artificial Sequence
  Description of Artificial Sequence: Synthetic oligonucleotide
  modified_base (20)..(21): 2'-methoxy-nucleotide
gacauccccagccgguucuuu

SEQ ID NO: 2039 - RNA, 21 nt, Artificial Sequence
  Description of Artificial Sequence: Synthetic oligonucleotide
  modified_base (20)..(21): 2'-methoxy-nucleotide
ggacauccccagccgguucuu

SEQ ID NO: 2040 - RNA, 21 nt, Artificial Sequence
  Description of Artificial Sequence: Synthetic oligonucleotide
  modified_base (20)..(21): 2'-methoxy-nucleotide
cggacauccccagccgguuuu

SEQ ID NO: 2041 - RNA, 21 nt, Artificial Sequence
  Description of Artificial Sequence: Synthetic oligonucleotide
  modified_base (20)..(21): 2'-methoxy-nucleotide
acggacauccccagccgguuu

SEQ ID NO: 2042 - RNA, 21 nt, Artificial Sequence
  Description of Artificial Sequence: Synthetic oligonucleotide
  modified_base (20)..(21): 2'-methoxy-nucleotide
gacggacauccccagccgguu

SEQ ID NO: 2043 - RNA, 21 nt, Artificial Sequence
  Description of Artificial Sequence: Synthetic oligonucleotide
  modified_base (20)..(21): 2'-methoxy-nucleotide
ugacggacauccccagccguu

SEQ ID NO: 2044 - RNA, 21 nt, Artificial Sequence
  Description of Artificial Sequence: Synthetic oligonucleotide
  modified_base (20)..(21): 2'-methoxy-nucleotide
cugacggacauccccagccuu

SEQ ID NO: 2045 - RNA, 21 nt, Artificial Sequence
  Description of Artificial Sequence: Synthetic oligonucleotide
  modified_base (20)..(21): 2'-methoxy-nucleotide
ucugacggacauccccagcuu

SEQ ID NO: 2046 - RNA, 21 nt, Artificial Sequence
  Description of Artificial Sequence: Synthetic oligonucleotide
  modified_base (20)..(21): 2'-methoxy-nucleotide
uucugacggacauccccaguu

SEQ ID NO: 2047 - RNA, 21 nt, Artificial Sequence
  Description of Artificial Sequence: Synthetic oligonucleotide
  modified_base (20)..(21): 2'-methoxy-nucleotide
guucugacggacauccccauu

SEQ ID NO: 2048 - RNA, 21 nt, Artificial Sequence
  Description of Artificial Sequence: Synthetic oligonucleotide
  modified_base (20)..(21): 2'-methoxy-nucleotide
gguucugacggacauccccuu

SEQ ID NO: 2049 - RNA, 21 nt, Artificial Sequence
  Description of Artificial Sequence: Synthetic oligonucleotide
  modified_base (20)..(21): 2'-methoxy-nucleotide
ggguucugacggacaucccuu

SEQ ID NO: 2050 - RNA, 21 nt, Artificial Sequence
  Description of Artificial Sequence: Synthetic oligonucleotide
  modified_base (20)..(21): 2'-methoxy-nucleotide
uggguucugacggacauccuu

SEQ ID NO: 2051 - RNA, 21 nt, Artificial Sequence
  Description of Artificial Sequence: Synthetic oligonucleotide
  modified_base (20)..(21): 2'-methoxy-nucleotide
auggguucugacggacaucuu

SEQ ID NO: 2052 - RNA, 21 nt, Artificial Sequence
  Description of Artificial Sequence: Synthetic oligonucleotide
  modified_base (20)..(21): 2'-methoxy-nucleotide
cauggguucugacggacauuu

SEQ ID NO: 2053 - RNA, 21 nt, Artificial Sequence
  Description of Artificial Sequence: Synthetic oligonucleotide
  modified_base (20)..(21): 2'-methoxy-nucleotide
gcauggguucugacggacauu

SEQ ID NO: 2054 - RNA, 21 nt, Artificial Sequence
  Description of Artificial Sequence: Synthetic oligonucleotide
  modified_base (20)..(21): 2'-methoxy-nucleotide
cgcauggguucugacggacuu

SEQ ID NO: 2055 - RNA, 21 nt, Artificial Sequence
  Description of Artificial Sequence: Synthetic oligonucleotide
  modified_base (20)..(21): 2'-methoxy-nucleotide
ccgcauggguucugacggauu

SEQ ID NO: 2056 - RNA, 21 nt, Artificial Sequence
  Description of Artificial Sequence: Synthetic oligonucleotide
  modified_base (20)..(21): 2'-methoxy-nucleotide
gccgcauggguucugacgguu

SEQ ID NO: 2057 - RNA, 21 nt, Artificial Sequence
  Description of Artificial Sequence: Synthetic oligonucleotide
  modified_base (20)..(21): 2'-methoxy-nucleotide
ugccgcauggguucugacguu

SEQ ID NO: 2058 - RNA, 21 nt, Artificial Sequence
  Description of Artificial Sequence: Synthetic oligonucleotide
  modified_base (20)..(21): 2'-methoxy-nucleotide
cugccgcauggguucugacuu

SEQ ID NO: 2059 - RNA, 21 nt, Artificial Sequence
  Description of Artificial Sequence: Synthetic oligonucleotide
  modified_base (20)..(21): 2'-methoxy-nucleotide
gcugccgcauggguucugauu

SEQ ID NO: 2060 - RNA, 21 nt, Artificial Sequence
  Description of Artificial Sequence: Synthetic oligonucleotide
  modified_base (20)..(21): 2'-methoxy-nucleotide
ugcugccgcauggguucuguu

SEQ ID NO: 2061 - RNA, 21 nt, Artificial Sequence
  Description of Artificial Sequence: Synthetic oligonucleotide
  modified_base (20)..(21): 2'-methoxy-nucleotide
uugcugccgcauggguucuuu

SEQ ID NO: 2062 - RNA, 21 nt, Artificial Sequence
  Description of Artificial Sequence: Synthetic oligonucleotide
  modified_base (20)..(21): 2'-methoxy-nucleotide
cuugcugccgcauggguucuu

SEQ ID NO: 2063 - RNA, 21 nt, Artificial Sequence
  Description of Artificial Sequence: Synthetic oligonucleotide
  modified_base (20)..(21): 2'-methoxy-nucleotide
ccuugcugccgcauggguuuu

SEQ ID NO: 2064 - RNA, 21 nt, Artificial Sequence
  Description of Artificial Sequence: Synthetic oligonucleotide
  modified_base (20)..(21): 2'-methoxy-nucleotide
gccuugcugccgcauggguuu

SEQ ID NO: 2065 - RNA, 21 nt, Artificial Sequence
  Description of Artificial Sequence: Synthetic oligonucleotide
  modified_base (20)..(21): 2'-methoxy-nucleotide
ggccuugcugccgcauggguu

SEQ ID NO: 2066 - RNA, 21 nt, Artificial Sequence
  Description of Artificial Sequence: Synthetic oligonucleotide
  modified_base (20)..(21): 2'-methoxy-nucleotide
aggccuugcugccgcaugguu

SEQ ID NO: 2067 - RNA, 21 nt, Artificial Sequence
  Description of Artificial Sequence: Synthetic oligonucleotide
  modified_base (20)..(21): 2'-methoxy-nucleotide
caggccuugcugccgcauguu

SEQ ID NO: 2068 - RNA, 21 nt, Artificial Sequence
  Description of Artificial Sequence: Synthetic oligonucleotide
  modified_base (20)..(21): 2'-methoxy-nucleotide
gcaggccuugcugccgcauuu

SEQ ID NO: 2069 - RNA, 21 nt, Artificial Sequence
  Description of Artificial Sequence: Synthetic oligonucleotide
  modified_base (20)..(21): 2'-methoxy-nucleotide
ggcaggccuugcugccgcauu

SEQ ID NO: 2070 - RNA, 21 nt, Artificial Sequence
  Description of Artificial Sequence: Synthetic oligonucleotide
  modified_base (20)..(21): 2'-methoxy-nucleotide
cggcaggccuugcugccgcuu

SEQ ID NO: 2071 - RNA, 21 nt, Artificial Sequence
  Description of Artificial Sequence: Synthetic oligonucleotide
  modified_base (20)..(21): 2'-methoxy-nucleotide
gcggcaggccuugcugccguu

SEQ ID NO: 2072 - RNA, 21 nt, Artificial Sequence
  Description of Artificial Sequence: Synthetic oligonucleotide
  modified_base (20)..(21): 2'-methoxy-nucleotide
ggcggcaggccuugcugccuu

SEQ ID NO: 2073 - RNA, 21 nt, Artificial Sequence
  Description of Artificial Sequence: Synthetic oligonucleotide
  modified_base (20)..(21): 2'-methoxy-nucleotide
cggcggcaggccuugcugcuu

SEQ ID NO: 2074 - RNA, 21 nt, Artificial Sequence
  Description of Artificial Sequence: Synthetic oligonucleotide
  modified_base (20)..(21): 2'-methoxy-nucleotide
gcggcggcaggccuugcuguu

SEQ ID NO: 2075 - RNA, 21 nt, Artificial Sequence
  Description of Artificial Sequence: Synthetic oligonucleotide
  modified_base (20)..(21): 2'-methoxy-nucleotide
ggcggcggcaggccuugcuuu

SEQ ID NO: 2076 - RNA, 21 nt, Artificial Sequence
  Description of Artificial Sequence: Synthetic oligonucleotide
  modified_base (20)..(21): 2'-methoxy-nucleotide
aggcggcggcaggccuugcuu

SEQ ID NO: 2077 - RNA, 21 nt, Artificial Sequence
  Description of Artificial Sequence: Synthetic oligonucleotide
  modified_base (20)..(21): 2'-methoxy-nucleotide
gaggcggcggcaggccuuguu

SEQ ID NO: 2078 - RNA, 21 nt, Artificial Sequence
  Description of Artificial Sequence: Synthetic oligonucleotide
  modified_base (20)..(21): 2'-methoxy-nucleotide
agaggcggcggcaggccuuuu

SEQ ID NO: 2079 - RNA, 21 nt, Artificial Sequence
  Description of Artificial Sequence: Synthetic oligonucleotide
  modified_base (20)..(21): 2'-methoxy-nucleotide
aagaggcggcggcaggccuuu

SEQ ID NO: 2080 - RNA, 21 nt, Artificial Sequence
  Description of Artificial Sequence: Synthetic oligonucleotide
  modified_base (20)..(21): 2'-methoxy-nucleotide
gaagaggcggcggcaggccuu

SEQ ID NO: 2081 - RNA, 21 nt, Artificial Sequence
  Description of Artificial Sequence: Synthetic oligonucleotide
  modified_base (20)..(21): 2'-methoxy-nucleotide
cgaagaggcggcggcaggcuu

SEQ ID NO: 2082 - RNA, 21 nt, Artificial Sequence
  Description of Artificial Sequence: Synthetic oligonucleotide
  modified_base (20)..(21): 2'-methoxy-nucleotide
ccgaagaggcggcggcagguu

SEQ ID NO: 2083 - RNA, 21 nt, Artificial Sequence
  Description of Artificial Sequence: Synthetic oligonucleotide
  modified_base (20)..(21): 2'-methoxy-nucleotide
gccgaagaggcggcggcaguu

SEQ ID NO: 2084 - RNA, 21 nt, Artificial Sequence
  Description of Artificial Sequence: Synthetic oligonucleotide
  modified_base (20)..(21): 2'-methoxy-nucleotide
ggccgaagaggcggcggcauu

SEQ ID NO: 2085 - RNA, 21 nt, Artificial Sequence
  Description of Artificial Sequence: Synthetic oligonucleotide
  modified_base (20)..(21): 2'-methoxy-nucleotide
gggccgaagaggcggcggcuu

SEQ ID NO: 2086 - RNA, 21 nt, Artificial Sequence
  Description of Artificial Sequence: Synthetic oligonucleotide
  modified_base (20)..(21): 2'-methoxy-nucleotide
ugggccgaagaggcggcgguu

SEQ ID NO: 2087 - RNA, 21 nt, Artificial Sequence
  Description of Artificial Sequence: Synthetic oligonucleotide
  modified_base (20)..(21): 2'-methoxy-nucleotide
cugggccgaagaggcggcguu

SEQ ID NO: 2088 - RNA, 21 nt, Artificial Sequence
  Description of Artificial Sequence: Synthetic oligonucleotide
  modified_base (20)..(21): 2'-methoxy-nucleotide
acugggccgaagaggcggcuu

SEQ ID NO: 2089 - RNA, 21 nt, Artificial Sequence
  Description of Artificial Sequence: Synthetic oligonucleotide
  modified_base (20)..(21): 2'-methoxy-nucleotide
cacugggccgaagaggcgguu

SEQ ID NO: 2090 - RNA, 21 nt, Artificial Sequence
  Description of Artificial Sequence: Synthetic oligonucleotide
  modified_base (20)..(21): 2'-methoxy-nucleotide
ccacugggccgaagaggcguu

SEQ ID NO: 2091 - RNA, 21 nt, Artificial Sequence
  Description of Artificial Sequence: Synthetic oligonucleotide
  modified_base (20)..(21): 2'-methoxy-nucleotide
uccacugggccgaagaggcuu

SEQ ID NO: 2092 - RNA, 21 nt, Artificial Sequence
  Description of Artificial Sequence: Synthetic oligonucleotide
  modified_base (20)..(21): 2'-methoxy-nucleotide
guccacugggccgaagagguu

SEQ ID NO: 2093 - RNA, 21 nt, Artificial Sequence
  Description of Artificial Sequence: Synthetic oligonucleotide
  modified_base (20)..(21): 2'-methoxy-nucleotide
uguccacugggccgaagaguu

SEQ ID NO: 2094 - RNA, 21 nt, Artificial Sequence
  Description of Artificial Sequence: Synthetic oligonucleotide
  modified_base (20)..(21): 2'-methoxy-nucleotide
cuguccacugggccgaagauu

SEQ ID NO: 2095 - RNA, 21 nt, Artificial Sequence
  Description of Artificial Sequence: Synthetic oligonucleotide
  modified_base (20)..(21): 2'-methoxy-nucleotide
gcuguccacugggccgaaguu

SEQ ID NO: 2096 - RNA, 21 nt, Artificial Sequence
  Description of Artificial Sequence: Synthetic oligonucleotide
  modified_base (20)..(21): 2'-methoxy-nucleotide
cgcuguccacugggccgaauu

SEQ ID NO: 2097 - RNA, 21 nt, Artificial Sequence
  Description of Artificial Sequence: Synthetic oligonucleotide
  modified_base (20)..(21): 2'-methoxy-nucleotide
ucgcuguccacugggccgauu

SEQ ID NO: 2098 - RNA, 21 nt, Artificial Sequence
  Description of Artificial Sequence: Synthetic oligonucleotide
  modified_base (20)..(21): 2'-methoxy-nucleotide
cucgcuguccacugggccguu

SEQ ID NO: 2099 - RNA, 21 nt, Artificial Sequence
  Description of Artificial Sequence: Synthetic oligonucleotide
  modified_base (20)..(21): 2'-methoxy-nucleotide
gcucgcuguccacugggccuu

SEQ ID NO: 2100 - RNA, 21 nt, Artificial Sequence
  Description of Artificial Sequence: Synthetic oligonucleotide
  modified_base (20)..(21): 2'-methoxy-nucleotide
ugcucgcuguccacugggcuu

SEQ ID NO: 2101 - RNA, 21 nt, Artificial Sequence
  Description of Artificial Sequence: Synthetic oligonucleotide
  modified_base (20)..(21): 2'-methoxy-nucleotide
cugcucgcuguccacuggguu

SEQ ID NO: 2102 - RNA, 21 nt, Artificial Sequence
  Description of Artificial Sequence: Synthetic oligonucleotide
  modified_base (20)..(21): 2'-methoxy-nucleotide
gcugcucgcuguccacugguu

SEQ ID NO: 2103 - RNA, 21 nt, Artificial Sequence
  Description of Artificial Sequence: Synthetic oligonucleotide
  modified_base (20)..(21): 2'-methoxy-nucleotide
agcugcucgcuguccacuguu

SEQ ID NO: 2104 - RNA, 21 nt, Artificial Sequence
  Description of Artificial Sequence: Synthetic oligonucleotide
  modified_base (20)..(21): 2'-methoxy-nucleotide
cagcugcucgcuguccacuuu

SEQ ID NO: 2105 - RNA, 21 nt, Artificial Sequence
  Description of Artificial Sequence: Synthetic oligonucleotide
  modified_base (20)..(21): 2'-methoxy-nucleotide
ucagcugcucgcuguccacuu

SEQ ID NO: 2106 - RNA, 21 nt, Artificial Sequence
  Description of Artificial Sequence: Synthetic oligonucleotide
  modified_base (20)..(21): 2'-methoxy-nucleotide
cucagcugcucgcuguccauu

SEQ ID NO: 2107 - RNA, 21 nt, Artificial Sequence
  Description of Artificial Sequence: Synthetic oligonucleotide
  modified_base (20)..(21): 2'-methoxy-nucleotide
gcucagcugcucgcuguccuu

SEQ ID NO: 2108 - RNA, 21 nt, Artificial Sequence
  Description of Artificial Sequence: Synthetic oligonucleotide
  modified_base (20)..(21): 2'-methoxy-nucleotide
ggcucagcugcucgcugucuu

SEQ ID NO: 2109 - RNA, 21 nt, Artificial Sequence
  Description of Artificial Sequence: Synthetic oligonucleotide
  modified_base (20)..(21): 2'-methoxy-nucleotide
cggcucagcugcucgcuguuu

SEQ ID NO: 2110 - RNA, 21 nt, Artificial Sequence
  Description of Artificial Sequence: Synthetic oligonucleotide
  modified_base (20)..(21): 2'-methoxy-nucleotide
gcggcucagcugcucgcuguu

SEQ ID NO: 2111 - RNA, 21 nt, Artificial Sequence
  Description of Artificial Sequence: Synthetic oligonucleotide
  modified_base (20)..(21): 2'-methoxy-nucleotide
cgcggcucagcugcucgcuuu

SEQ ID NO: 2112 - RNA, 21 nt, Artificial Sequence
  Description of Artificial Sequence: Synthetic oligonucleotide
  modified_base (20)..(21): 2'-methoxy-nucleotide
ucgcggcucagcugcucgcuu

SEQ ID NO: 2113 - RNA, 21 nt, Artificial Sequence
  Description of Artificial Sequence: Synthetic oligonucleotide
  modified_base (20)..(21): 2'-methoxy-nucleotide
gucgcggcucagcugcucguu

SEQ ID NO: 2114 - RNA, 21 nt, Artificial Sequence
  Description of Artificial Sequence: Synthetic oligonucleotide
  modified_base (20)..(21): 2'-methoxy-nucleotide
agucgcggcucagcugcucuu

SEQ ID NO: 2115 - RNA, 21 nt, Artificial Sequence
  Description of Artificial Sequence: Synthetic oligonucleotide
  modified_base (20)..(21): 2'-methoxy-nucleotide
cagucgcggcucagcugcuuu

SEQ ID NO: 2116 - RNA, 21 nt, Artificial Sequence
  Description of Artificial Sequence: Synthetic oligonucleotide
  modified_base (20)..(21): 2'-methoxy-nucleotide
acagucgcggcucagcugcuu

SEQ ID NO: 2117 - RNA, 21 nt, Artificial Sequence
  Description of Artificial Sequence: Synthetic oligonucleotide
  modified_base (20)..(21): 2'-methoxy-nucleotide
cacagucgcggcucagcuguu

SEQ ID NO: 2118 - RNA, 21 nt, Artificial Sequence
  Description of Artificial Sequence: Synthetic oligonucleotide
  modified_base (20)..(21): 2'-methoxy-nucleotide
ucacagucgcggcucagcuuu

SEQ ID NO: 2119 - RNA, 21 nt, Artificial Sequence
  Description of Artificial Sequence: Synthetic oligonucleotide
  modified_base (20)..(21): 2'-methoxy-nucleotide
aucacagucgcggcucagcuu

SEQ ID NO: 2120 - RNA, 21 nt, Artificial Sequence
  Description of Artificial Sequence: Synthetic oligonucleotide
  modified_base (20)..(21): 2'-methoxy-nucleotide
caucacagucgcggcucaguu

SEQ ID NO: 2121 - RNA, 21 nt, Artificial Sequence
  Description of Artificial Sequence: Synthetic oligonucleotide
  modified_base (20)..(21): 2'-methoxy-nucleotide
gcaucacagucgcggcucauu

SEQ ID NO: 2122 - RNA, 21 nt, Artificial Sequence
  Description of Artificial Sequence: Synthetic oligonucleotide
  modified_base (20)..(21): 2'-methoxy-nucleotide
cgcaucacagucgcggcucuu

SEQ ID NO: 2123 - RNA, 21 nt, Artificial Sequence
  Description of Artificial Sequence: Synthetic oligonucleotide
  modified_base (20)..(21): 2'-methoxy-nucleotide
gcgcaucacagucgcggcuuu

SEQ ID NO: 2124 - RNA, 21 nt, Artificial Sequence
  Description of Artificial Sequence: Synthetic oligonucleotide
  modified_base (20)..(21): 2'-methoxy-nucleotide
agcgcaucacagucgcggcuu

SEQ ID NO: 2125 - RNA, 21 nt, Artificial Sequence
  Description of Artificial Sequence: Synthetic oligonucleotide
  modified_base (20)..(21): 2'-methoxy-nucleotide
uagcgcaucacagucgcgguu

SEQ ID NO: 2126 - RNA, 21 nt, Artificial Sequence
  Description of Artificial Sequence: Synthetic oligonucleotide
  modified_base (20)..(21): 2'-methoxy-nucleotide
uuagcgcaucacagucgcguu

SEQ ID NO: 2127 - RNA, 21 nt, Artificial Sequence
  Description of Artificial Sequence: Synthetic oligonucleotide
  modified_base (20)..(21): 2'-methoxy-nucleotide
auuagcgcaucacagucgcuu

SEQ ID NO: 2128 - RNA, 21 nt, Artificial Sequence
  Description of Artificial Sequence: Synthetic oligonucleotide
  modified_base (20)..(21): 2'-methoxy-nucleotide
cauuagcgcaucacagucguu

SEQ ID NO: 2129 - RNA, 21 nt, Artificial Sequence
  Description of Artificial Sequence: Synthetic oligonucleotide
  modified_base (20)..(21): 2'-methoxy-nucleotide
ccauuagcgcaucacagucuu

SEQ ID NO: 2130 - RNA, 21 nt, Artificial Sequence
  Description of Artificial Sequence: Synthetic oligonucleotide
  modified_base (20)..(21): 2'-methoxy-nucleotide
gccauuagcgcaucacaguuu

SEQ ID NO: 2131 - RNA, 21 nt, Artificial Sequence
  Description of Artificial Sequence: Synthetic oligonucleotide
  modified_base (20)..(21): 2'-methoxy-nucleotide
cgccauuagcgcaucacaguu

SEQ ID NO: 2132 - RNA, 21 nt, Artificial Sequence
  Description of Artificial Sequence: Synthetic oligonucleotide
  modified_base (20)..(21): 2'-methoxy-nucleotide
ccgccauuagcgcaucacauu

SEQ ID NO: 2133 - RNA, 21 nt, Artificial Sequence
  Description of Artificial Sequence: Synthetic oligonucleotide
  modified_base (20)..(21): 2'-methoxy-nucleotide
cccgccauuagcgcaucacuu

SEQ ID NO: 2134 - RNA, 21 nt, Artificial Sequence
  Description of Artificial Sequence: Synthetic oligonucleotide
  modified_base (20)..(21): 2'-methoxy-nucleotide
gcccgccauuagcgcaucauu

SEQ ID NO: 2135 - RNA, 21 nt, Artificial Sequence
  Description of Artificial Sequence: Synthetic oligonucleotide
  modified_base (20)..(21): 2'-methoxy-nucleotide
agcccgccauuagcgcaucuu

SEQ ID NO: 2136 - RNA, 21 nt, Artificial Sequence
  Description of Artificial Sequence: Synthetic oligonucleotide
  modified_base (20)..(21): 2'-methoxy-nucleotide
cagcccgccauuagcgcauuu

SEQ ID NO: 2137 - RNA, 21 nt, Artificial Sequence
  Description of Artificial Sequence: Synthetic oligonucleotide
  modified_base (20)..(21): 2'-methoxy-nucleotide
gcagcccgccauuagcgcauu

SEQ ID NO: 2138 - RNA, 21 nt, Artificial Sequence
  Description of Artificial Sequence: Synthetic oligonucleotide
  modified_base (20)..(21): 2'-methoxy-nucleotide
ugcagcccgccauuagcgcuu

SEQ ID NO: 2139 - RNA, 21 nt, Artificial Sequence
  Description of Artificial Sequence: Synthetic oligonucleotide
  modified_base (20)..(21): 2'-methoxy-nucleotide
augcagcccgccauuagcguu

SEQ ID NO: 2140 - RNA, 21 nt, Artificial Sequence
  Description of Artificial Sequence: Synthetic oligonucleotide
  modified_base (20)..(21): 2'-methoxy-nucleotide
gaugcagcccgccauuagcuu

SEQ ID NO: 2141 - RNA, 21 nt, Artificial Sequence
  Description of Artificial Sequence: Synthetic oligonucleotide
  modified_base (20)..(21): 2'-methoxy-nucleotide
ggaugcagcccgccauuaguu

SEQ ID NO: 2142 - RNA, 21 nt, Artificial Sequence
  Description of Artificial Sequence: Synthetic oligonucleotide
  modified_base (20)..(21): 2'-methoxy-nucleotide
uggaugcagcccgccauuauu

SEQ ID NO: 2143 - RNA, 21 nt, Artificial Sequence
  Description of Artificial Sequence: Synthetic oligonucleotide
  modified_base (20)..(21): 2'-methoxy-nucleotide
cuggaugcagcccgccauuuu

SEQ ID NO: 2144 - RNA, 21 nt, Artificial Sequence
  Description of Artificial Sequence: Synthetic oligonucleotide
  modified_base (20)..(21): 2'-methoxy-nucleotide
ccuggaugcagcccgccauuu

SEQ ID NO: 2145 - RNA, 21 nt, Artificial Sequence
  Description of Artificial Sequence: Synthetic oligonucleotide
  modified_base (20)..(21): 2'-methoxy-nucleotide
uccuggaugcagcccgccauu

SEQ ID NO: 2146 - RNA, 21 nt, Artificial Sequence
  Description of Artificial Sequence: Synthetic oligonucleotide
  modified_base (20)..(21): 2'-methoxy-nucleotide
cuccuggaugcagcccgccuu

SEQ ID NO: 2147 - RNA, 21 nt, Artificial Sequence
  Description of Artificial Sequence: Synthetic oligonucleotide
  modified_base (20)..(21): 2'-methoxy-nucleotide
ccuccuggaugcagcccgcuu

SEQ ID NO: 2148 - RNA, 21 nt, Artificial Sequence
  Description of Artificial Sequence: Synthetic oligonucleotide
  modified_base (20)..(21): 2'-methoxy-nucleotide
gccuccuggaugcagcccguu

SEQ ID NO: 2149 - RNA, 21 nt, Artificial Sequence
  Description of Artificial Sequence: Synthetic oligonucleotide
  modified_base (20)..(21): 2'-methoxy-nucleotide
ggccuccuggaugcagcccuu

SEQ ID NO: 2150 - RNA, 21 nt, Artificial Sequence
  Description of Artificial Sequence: Synthetic oligonucleotide
  modified_base (20)..(21): 2'-methoxy-nucleotide
gggccuccuggaugcagccuu

SEQ ID NO: 2151 - RNA, 21 nt, Artificial Sequence
  Description of Artificial Sequence: Synthetic oligonucleotide
  modified_base (20)..(21): 2'-methoxy-nucleotide
cgggccuccuggaugcagcuu

SEQ ID NO: 2152 - RNA, 21 nt, Artificial Sequence
  Description of Artificial Sequence: Synthetic oligonucleotide
  modified_base (20)..(21): 2'-methoxy-nucleotide
acgggccuccuggaugcaguu

SEQ ID NO: 2153 - RNA, 21 nt, Artificial Sequence
  Description of Artificial Sequence: Synthetic oligonucleotide
  modified_base (20)..(21): 2'-methoxy-nucleotide
cacgggccuccuggaugcauu

SEQ ID NO: 2154 - RNA, 21 nt, Artificial Sequence
  Description of Artificial Sequence: Synthetic oligonucleotide
  modified_base (20)..(21): 2'-methoxy-nucleotide
ucacgggccuccuggaugcuu

SEQ ID NO: 2155 - RNA, 21 nt, Artificial Sequence
  Description of Artificial Sequence: Synthetic oligonucleotide
  modified_base (20)..(21): 2'-methoxy-nucleotide
cucacgggccuccuggauguu

SEQ ID NO: 2156 - RNA, 21 nt, Artificial Sequence
  Description of Artificial Sequence: Synthetic oligonucleotide
  modified_base (20)..(21): 2'-methoxy-nucleotide
gcucacgggccuccuggauuu

SEQ ID NO: 2157 - RNA, 21 nt, Artificial Sequence
  Description of Artificial Sequence: Synthetic oligonucleotide
  modified_base (20)..(21): 2'-methoxy-nucleotide
cgcucacgggccuccuggauu

SEQ ID NO: 2158 - RNA, 21 nt, Artificial Sequence
  Description of Artificial Sequence: Synthetic oligonucleotide
  modified_base (20)..(21): 2'-methoxy-nucleotide
ucgcucacgggccuccugguu

SEQ ID NO: 2159 - RNA, 21 nt, Artificial Sequence
  Description of Artificial Sequence: Synthetic oligonucleotide
  modified_base (20)..(21): 2'-methoxy-nucleotide
aucgcucacgggccuccuguu

SEQ ID NO: 2160 - RNA, 21 nt, Artificial Sequence
  Description of Artificial Sequence: Synthetic oligonucleotide
  modified_base (20)..(21): 2'-methoxy-nucleotide
caucgcucacgggccuccuuu

SEQ ID NO: 2161 - RNA, 21 nt, Artificial Sequence
  Description of Artificial Sequence: Synthetic oligonucleotide
  modified_base (20)..(21): 2'-methoxy-nucleotide
ccaucgcucacgggccuccuu

SEQ ID NO: 2162 - RNA, 21 nt, Artificial Sequence
  Description of Artificial Sequence: Synthetic oligonucleotide
  modified_base (20)..(21): 2'-methoxy-nucleotide
uccaucgcucacgggccucuu

SEQ ID NO: 2163 - RNA, 21 nt, Artificial Sequence
  Description of Artificial Sequence: Synthetic oligonucleotide
  modified_base (20)..(21): 2'-methoxy-nucleotide
uuccaucgcucacgggccuuu

SEQ ID NO: 2164 - RNA, 21 nt, Artificial Sequence
  Description of Artificial Sequence: Synthetic oligonucleotide
  modified_base (20)..(21): 2'-methoxy-nucleotide
guuccaucgcucacgggccuu

SEQ ID NO: 2165 - RNA, 21 nt, Artificial Sequence
  Description of Artificial Sequence: Synthetic oligonucleotide
  modified_base (20)..(21): 2'-methoxy-nucleotide
aguuccaucgcucacgggcuu

SEQ ID NO: 2166 - RNA, 21 nt, Artificial Sequence
  Description of Artificial Sequence: Synthetic oligonucleotide
  modified_base (20)..(21): 2'-methoxy-nucleotide
aaguuccaucgcucacggguu

SEQ ID NO: 2167 - RNA, 21 nt, Artificial Sequence
  Description of Artificial Sequence: Synthetic oligonucleotide
  modified_base (20)..(21): 2'-methoxy-nucleotide
gaaguuccaucgcucacgguu

SEQ ID NO: 2168 - RNA, 21 nt, Artificial Sequence
  Description of Artificial Sequence: Synthetic oligonucleotide
  modified_base (20)..(21): 2'-methoxy-nucleotide
cgaaguuccaucgcucacguu

SEQ ID NO: 2169 - RNA, 21 nt, Artificial Sequence
  Description of Artificial Sequence: Synthetic oligonucleotide
  modified_base (20)..(21): 2'-methoxy-nucleotide
ucgaaguuccaucgcucacuu

SEQ ID NO: 2170 - RNA, 21 nt, Artificial Sequence
  Description of Artificial Sequence: Synthetic oligonucleotide
  modified_base (20)..(21): 2'-methoxy-nucleotide
gucgaaguuccaucgcucauu

SEQ ID NO: 2171 - RNA, 21 nt, Artificial Sequence
  Description of Artificial Sequence: Synthetic oligonucleotide
  modified_base (20)..(21): 2'-methoxy-nucleotide
agucgaaguuccaucgcucuu

SEQ ID NO: 2172 - RNA, 21 nt, Artificial Sequence
  Description of Artificial Sequence: Synthetic oligonucleotide
  modified_base (20)..(21): 2'-methoxy-nucleotide
aagucgaaguuccaucgcuuu

SEQ ID NO: 2173 - RNA, 21 nt, Artificial Sequence
  Description of Artificial Sequence: Synthetic oligonucleotide
  modified_base (20)..(21): 2'-methoxy-nucleotide
aaagucgaaguuccaucgcuu

SEQ ID NO: 2174 - RNA, 21 nt, Artificial Sequence
  Description of Artificial Sequence: Synthetic oligonucleotide
  modified_base (20)..(21): 2'-methoxy-nucleotide
caaagucgaaguuccaucguu

SEQ ID NO: 2175 - RNA, 21 nt, Artificial Sequence
  Description of Artificial Sequence: Synthetic oligonucleotide
  modified_base (20)..(21): 2'-methoxy-nucleotide
acaaagucgaaguuccaucuu

SEQ ID NO: 2176 - RNA, 21 nt, Artificial Sequence
  Description of Artificial Sequence: Synthetic oligonucleotide
  modified_base (20)..(21): 2'-methoxy-nucleotide
gacaaagucgaaguuccauuu

SEQ ID NO: 2177 - RNA, 21 nt, Artificial Sequence
  Description of Artificial Sequence: Synthetic oligonucleotide
  modified_base (20)..(21): 2'-methoxy-nucleotide
ugacaaagucgaaguuccauu

SEQ ID NO: 2178 - RNA, 21 nt, Artificial Sequence
  Description of Artificial Sequence: Synthetic oligonucleotide
  modified_base (20)..(21): 2'-methoxy-nucleotide
gugacaaagucgaaguuccuu

SEQ ID NO: 2179 - RNA, 21 nt, Artificial Sequence
  Description of Artificial Sequence: Synthetic oligonucleotide
  modified_base (20)..(21): 2'-methoxy-nucleotide
ggugacaaagucgaaguucuu

SEQ ID NO: 2180 - RNA, 21 nt, Artificial Sequence
  Description of Artificial Sequence: Synthetic oligonucleotide
  modified_base (20)..(21): 2'-methoxy-nucleotide
cggugacaaagucgaaguuuu

SEQ ID NO: 2181 - RNA, 21 nt, Artificial Sequence
  Description of Artificial Sequence: Synthetic oligonucleotide
  modified_base (20)..(21): 2'-methoxy-nucleotide
ucggugacaaagucgaaguuu

SEQ ID NO: 2182 - RNA, 21 nt, Artificial Sequence
  Description of Artificial Sequence: Synthetic oligonucleotide
  modified_base (20)..(21): 2'-methoxy-nucleotide
cucggugacaaagucgaaguu

SEQ ID NO: 2183 - RNA, 21 nt, Artificial Sequence
  Description of Artificial Sequence: Synthetic oligonucleotide
  modified_base (20)..(21): 2'-methoxy-nucleotide
ucucggugacaaagucgaauu

SEQ ID NO: 2184 - RNA, 21 nt, Artificial Sequence
  Description of Artificial Sequence: Synthetic oligonucleotide
  modified_base (20)..(21): 2'-methoxy-nucleotide
gucucggugacaaagucgauu

SEQ ID NO: 2185 - RNA, 21 nt, Artificial Sequence
  Description of Artificial Sequence: Synthetic oligonucleotide
  modified_base (20)..(21): 2'-methoxy-nucleotide
ugucucggugacaaagucguu

SEQ ID NO: 2186 - RNA, 21 nt, Artificial Sequence
  Description of Artificial Sequence: Synthetic oligonucleotide
  modified_base (20)..(21): 2'-methoxy-nucleotide
gugucucggugacaaagucuu

SEQ ID NO: 2187 - RNA, 21 nt, Artificial Sequence
  Description of Artificial Sequence: Synthetic oligonucleotide
  modified_base (20)..(21): 2'-methoxy-nucleotide
ggugucucggugacaaaguuu

SEQ ID NO: 2188 - RNA, 21 nt, Artificial Sequence
  Description of Artificial Sequence: Synthetic oligonucleotide
  modified_base (20)..(21): 2'-methoxy-nucleotide
uggugucucggugacaaaguu

SEQ ID NO: 2189 - RNA, 21 nt, Artificial Sequence
  Description of Artificial Sequence: Synthetic oligonucleotide
  modified_base (20)..(21): 2'-methoxy-nucleotide
guggugucucggugacaaauu

SEQ ID NO: 2190 - RNA, 21 nt, Artificial Sequence
  Description of Artificial Sequence: Synthetic oligonucleotide
  modified_base (20)..(21): 2'-methoxy-nucleotide
aguggugucucggugacaauu

SEQ ID NO: 2191 - RNA, 21 nt, Artificial Sequence
  Description of Artificial Sequence: Synthetic oligonucleotide
  modified_base (20)..(21): 2'-methoxy-nucleotide
caguggugucucggugacauu

SEQ ID NO: 2192 - RNA, 21 nt, Artificial Sequence
  Description of Artificial Sequence: Synthetic oligonucleotide
  modified_base (20)..(21): 2'-methoxy-nucleotide
ccaguggugucucggugacuu

SEQ ID NO: 2193 - RNA, 21 nt, Artificial Sequence
  Description of Artificial Sequence: Synthetic oligonucleotide
  modified_base (20)..(21): 2'-methoxy-nucleotide
uccaguggugucucggugauu

SEQ ID NO: 2194 - RNA, 21 nt, Artificial Sequence
  Description of Artificial Sequence: Synthetic oligonucleotide
  modified_base (20)..(21): 2'-methoxy-nucleotide
cuccaguggugucucgguguu

SEQ ID NO: 2195 - RNA, 21 nt, Artificial Sequence
  Description of Artificial Sequence: Synthetic oligonucleotide
  modified_base (20)..(21): 2'-methoxy-nucleotide
ccuccaguggugucucgguuu

SEQ ID NO: 2196 - RNA, 21 nt, Artificial Sequence
  Description of Artificial Sequence: Synthetic oligonucleotide
  modified_base (20)..(21): 2'-methoxy-nucleotide
cccuccaguggugucucgguu

SEQ ID NO: 2197 - RNA, 21 nt, Artificial Sequence
  Description of Artificial Sequence: Synthetic oligonucleotide
  modified_base (20)..(21): 2'-methoxy-nucleotide
acccuccaguggugucucguu

SEQ ID NO: 2198 - RNA, 21 nt, Artificial Sequence
  Description of Artificial Sequence: Synthetic oligonucleotide
  modified_base (20)..(21): 2'-methoxy-nucleotide
cacccuccaguggugucucuu

SEQ ID NO: 2199 - RNA, 21 nt, Artificial Sequence
  Description of Artificial Sequence: Synthetic oligonucleotide
  modified_base (20)..(21): 2'-methoxy-nucleotide
ucacccuccaguggugucuuu

SEQ ID NO: 2200 - RNA, 21 nt, Artificial Sequence
  Description of Artificial Sequence: Synthetic oligonucleotide
  modified_base (20)..(21): 2'-methoxy-nucleotide
gucacccuccaguggugucuu

SEQ ID NO: 2201 - RNA, 21 nt, Artificial Sequence
  Description of Artificial Sequence: Synthetic oligonucleotide
  modified_base (20)..(21): 2'-methoxy-nucleotide
agucacccuccagugguguuu

SEQ ID NO: 2202 - RNA, 21 nt, Artificial Sequence
  Description of Artificial Sequence: Synthetic oligonucleotide
  modified_base (20)..(21): 2'-methoxy-nucleotide
aagucacccuccagugguguu

SEQ ID NO: 2203 - RNA, 21 nt, Artificial Sequence
  Description of Artificial Sequence: Synthetic oligonucleotide
  modified_base (20)..(21): 2'-methoxy-nucleotide
gaagucacccuccagugguuu

SEQ ID NO: 2204 - RNA, 21 nt, Artificial Sequence
  Description of Artificial Sequence: Synthetic oligonucleotide
  modified_base (20)..(21): 2'-methoxy-nucleotide
cgaagucacccuccagugguu

SEQ ID NO: 2205 - RNA, 21 nt, Artificial Sequence
  Description of Artificial Sequence: Synthetic oligonucleotide
  modified_base (20)..(21): 2'-methoxy-nucleotide
gcgaagucacccuccaguguu

SEQ ID NO: 2206 - RNA, 21 nt, Artificial Sequence
  Description of Artificial Sequence: Synthetic oligonucleotide
  modified_base (20)..(21): 2'-methoxy-nucleotide
ggcgaagucacccuccaguuu

SEQ ID NO: 2207 - RNA, 21 nt, Artificial Sequence
  Description of Artificial Sequence: Synthetic oligonucleotide
  modified_base (20)..(21): 2'-methoxy-nucleotide
aggcgaagucacccuccaguu

SEQ ID NO: 2208 - RNA, 21 nt, Artificial Sequence
  Description of Artificial Sequence: Synthetic oligonucleotide
  modified_base (20)..(21): 2'-methoxy-nucleotide
caggcgaagucacccuccauu

SEQ ID NO: 2209 - RNA, 21 nt, Artificial Sequence
  Description of Artificial Sequence: Synthetic oligonucleotide
  modified_base (20)..(21): 2'-methoxy-nucleotide
ccaggcgaagucacccuccuu

SEQ ID NO: 2210 - RNA, 21 nt, Artificial Sequence
  Description of Artificial Sequence: Synthetic oligonucleotide
  modified_base (20)..(21): 2'-methoxy-nucleotide
cccaggcgaagucacccucuu

SEQ ID NO: 2211 - RNA, 21 nt, Artificial Sequence
  Description of Artificial Sequence: Synthetic oligonucleotide
  modified_base (20)..(21): 2'-methoxy-nucleotide
ucccaggcgaagucacccuuu

SEQ ID NO: 2212 - RNA, 21 nt, Artificial Sequence
  Description of Artificial Sequence: Synthetic oligonucleotide
  modified_base (20)..(21): 2'-methoxy-nucleotide
cucccaggcgaagucacccuu

SEQ ID NO: 2213 - RNA, 21 nt, Artificial Sequence
  Description of Artificial Sequence: Synthetic oligonucleotide
  modified_base (20)..(21): 2'-methoxy-nucleotide
gcucccaggcgaagucaccuu

SEQ ID NO: 2214 - RNA, 21 nt, Artificial Sequence
  Description of Artificial Sequence: Synthetic oligonucleotide
  modified_base (20)..(21): 2'-methoxy-nucleotide
cgcucccaggcgaagucacuu

SEQ ID NO: 2215 - RNA, 21 nt, Artificial Sequence
  Description of Artificial Sequence: Synthetic oligonucleotide
  modified_base (20)..(21): 2'-methoxy-nucleotide
acgcucccaggcgaagucauu

SEQ ID NO: 2216 - RNA, 21 nt, Artificial Sequence
  Description of Artificial Sequence: Synthetic oligonucleotide
  modified_base (20)..(21): 2'-methoxy-nucleotide
cacgcucccaggcgaagucuu

SEQ ID NO: 2217 - RNA, 21 nt, Artificial Sequence
  Description of Artificial Sequence: Synthetic oligonucleotide
  modified_base (20)..(21): 2'-methoxy-nucleotide
acacgcucccaggcgaaguuu

SEQ ID NO: 2218 - RNA, 21 nt, Artificial Sequence
  Description of Artificial Sequence: Synthetic oligonucleotide
  modified_base (20)..(21): 2'-methoxy-nucleotide
cacacgcucccaggcgaaguu

SEQ ID NO: 2219 - RNA, 21 nt, Artificial Sequence
  Description of Artificial Sequence: Synthetic oligonucleotide
  modified_base (20)..(21): 2'-methoxy-nucleotide
gcacacgcucccaggcgaauu

SEQ ID NO: 2220 - RNA, 21 nt, Artificial Sequence
  Description of Artificial Sequence: Synthetic oligonucleotide
  modified_base (20)..(21): 2'-methoxy-nucleotide
cgcacacgcucccaggcgauu

SEQ ID NO: 2221 - RNA, 21 nt, Artificial Sequence
  Description of Artificial Sequence: Synthetic oligonucleotide
  modified_base (20)..(21): 2'-methoxy-nucleotide
ccgcacacgcucccaggcguu

SEQ ID NO: 2222 - RNA, 21 nt, Artificial Sequence
  Description of Artificial Sequence: Synthetic oligonucleotide
  modified_base (20)..(21): 2'-methoxy-nucleotide
cccgcacacgcucccaggcuu

SEQ ID NO: 2223 - RNA, 21 nt, Artificial Sequence
  Description of Artificial Sequence: Synthetic oligonucleotide
  modified_base (20)..(21): 2'-methoxy-nucleotide
ccccgcacacgcucccagguu

SEQ ID NO: 2224 - RNA, 21 nt, Artificial Sequence
  Description of Artificial Sequence: Synthetic oligonucleotide
  modified_base (20)..(21): 2'-methoxy-nucleotide
gccccgcacacgcucccaguu

SEQ ID NO: 2225 - RNA, 21 nt, Artificial Sequence
  Description of Artificial Sequence: Synthetic oligonucleotide
  modified_base (20)..(21): 2'-methoxy-nucleotide
ggccccgcacacgcucccauu

SEQ ID NO: 2226 - RNA, 21 nt, Artificial Sequence
  Description of Artificial Sequence: Synthetic oligonucleotide
  modified_base (20)..(21): 2'-methoxy-nucleotide
aggccccgcacacgcucccuu

SEQ ID NO: 2227 - RNA, 21 nt, Artificial Sequence
  Description of Artificial Sequence: Synthetic oligonucleotide
  modified_base (20)..(21): 2'-methoxy-nucleotide
aaggccccgcacacgcuccuu

SEQ ID NO: 2228 - RNA, 21 nt, Artificial Sequence
  Description of Artificial Sequence: Synthetic oligonucleotide
  modified_base (20)..(21): 2'-methoxy-nucleotide
caaggccccgcacacgcucuu

SEQ ID NO: 2229 - RNA, 21 nt, Artificial Sequence
  Description of Artificial Sequence: Synthetic oligonucleotide
  modified_base (20)..(21): 2'-methoxy-nucleotide
ccaaggccccgcacacgcuuu

SEQ ID NO: 2230 - RNA, 21 nt, Artificial Sequence
  Description of Artificial Sequence: Synthetic oligonucleotide
  modified_base (20)..(21): 2'-methoxy-nucleotide
gccaaggccccgcacacgcuu

SEQ ID NO: 2231 - RNA, 21 nt, Artificial Sequence
  Description of Artificial Sequence: Synthetic oligonucleotide
  modified_base (20)..(21): 2'-methoxy-nucleotide
ggccaaggccccgcacacguu

SEQ ID NO: 2232 - RNA, 21 nt, Artificial Sequence
  Description of Artificial Sequence: Synthetic oligonucleotide
  modified_base (20)..(21): 2'-methoxy-nucleotide
aggccaaggccccgcacacuu

SEQ ID NO: 2233 - RNA, 21 nt, Artificial Sequence
  Description of Artificial Sequence: Synthetic oligonucleotide
  modified_base (20)..(21): 2'-methoxy-nucleotide
caggccaaggccccgcacauu

SEQ ID NO: 2234 - RNA, 21 nt, Artificial Sequence
  Description of Artificial Sequence: Synthetic oligonucleotide
  modified_base (20)..(21): 2'-methoxy-nucleotide
gcaggccaaggccccgcacuu

SEQ ID NO: 2235 - RNA, 21 nt, Artificial Sequence
  Description of Artificial Sequence: Synthetic oligonucleotide
  modified_base (20)..(21): 2'-methoxy-nucleotide
ggcaggccaaggccccgcauu

SEQ ID NO: 2236 - RNA, 21 nt, Artificial Sequence
  Description of Artificial Sequence: Synthetic oligonucleotide
  modified_base (20)..(21): 2'-methoxy-nucleotide
gggcaggccaaggccccgcuu

SEQ ID NO: 2237 - RNA, 21 nt, Artificial Sequence
  Description of Artificial Sequence: Synthetic oligonucleotide
  modified_base (20)..(21): 2'-methoxy-nucleotide
ugggcaggccaaggccccguu

SEQ ID NO: 2238 - RNA, 21 nt, Artificial Sequence
  Description of Artificial Sequence: Synthetic oligonucleotide
  modified_base (20)..(21): 2'-methoxy-nucleotide
uugggcaggccaaggccccuu

SEQ ID NO: 2239 - RNA, 21 nt, Artificial Sequence
  Description of Artificial Sequence: Synthetic oligonucleotide
  modified_base (20)..(21): 2'-methoxy-nucleotide
cuugggcaggccaaggcccuu

SEQ ID NO: 2240 - RNA, 21 nt, Artificial Sequence
  Description of Artificial Sequence: Synthetic oligonucleotide
  modified_base (20)..(21): 2'-methoxy-nucleotide
gcuugggcaggccaaggccuu

SEQ ID NO: 2241 - RNA, 21 nt, Artificial Sequence
  Description of Artificial Sequence: Synthetic oligonucleotide
  modified_base (20)..(21): 2'-methoxy-nucleotide
agcuugggcaggccaaggcuu

SEQ ID NO: 2242 - RNA, 21 nt, Artificial Sequence
  Description of Artificial Sequence: Synthetic oligonucleotide
  modified_base (20)..(21): 2'-methoxy-nucleotide
gagcuugggcaggccaagguu

SEQ ID NO: 2243 - RNA, 21 nt, Artificial Sequence
  Description of Artificial Sequence: Synthetic oligonucleotide
  modified_base (20)..(21): 2'-methoxy-nucleotide
agagcuugggcaggccaaguu

SEQ ID NO: 2244 - RNA, 21 nt, Artificial Sequence
  Description of Artificial Sequence: Synthetic oligonucleotide
  modified_base (20)..(21): 2'-methoxy-nucleotide
uagagcuugggcaggccaauu

SEQ ID NO: 2245 - RNA, 21 nt, Artificial Sequence
  Description of Artificial Sequence: Synthetic oligonucleotide
  modified_base (20)..(21): 2'-methoxy-nucleotide
guagagcuugggcaggccauu

SEQ ID NO: 2246 - RNA, 21 nt, Artificial Sequence
  Description of Artificial Sequence: Synthetic oligonucleotide
  modified_base (20)..(21): 2'-methoxy-nucleotide
gguagagcuugggcaggccuu

SEQ ID NO: 2247 - RNA, 21 nt, Artificial Sequence
  Description of Artificial Sequence: Synthetic oligonucleotide
  modified_base (20)..(21): 2'-methoxy-nucleotide
agguagagcuugggcaggcuu

SEQ ID NO: 2248 - RNA, 21 nt, Artificial Sequence
  Description of Artificial Sequence: Synthetic oligonucleotide
  modified_base (20)..(21): 2'-methoxy-nucleotide
aagguagagcuugggcagguu

SEQ ID NO: 2249 - RNA, 21 nt, Artificial Sequence
  Description of Artificial Sequence: Synthetic oligonucleotide
  modified_base (20)..(21): 2'-methoxy-nucleotide
gaagguagagcuugggcaguu

SEQ ID NO: 2250 - RNA, 21 nt, Artificial Sequence
  Description of Artificial Sequence: Synthetic oligonucleotide
  modified_base (20)..(21): 2'-methoxy-nucleotide
ggaagguagagcuugggcauu

SEQ ID NO: 2251 - RNA, 21 nt, Artificial Sequence
  Description of Artificial Sequence: Synthetic oligonucleotide
  modified_base (20)..(21): 2'-methoxy-nucleotide
gggaagguagagcuugggcuu

SEQ ID NO: 2252 - RNA, 21 nt, Artificial Sequence
  Description of Artificial Sequence: Synthetic oligonucleotide
  modified_base (20)..(21): 2'-methoxy-nucleotide
ugggaagguagagcuuggguu

SEQ ID NO: 2253 - RNA, 21 nt, Artificial Sequence
  Description of Artificial Sequence: Synthetic oligonucleotide
  modified_base (20)..(21): 2'-methoxy-nucleotide
gugggaagguagagcuugguu

SEQ ID NO: 2254 - RNA, 21 nt, Artificial Sequence
  Description of Artificial Sequence: Synthetic oligonucleotide
  modified_base (20)..(21): 2'-methoxy-nucleotide
cgugggaagguagagcuuguu

SEQ ID NO: 2255 - RNA, 21 nt, Artificial Sequence
  Description of Artificial Sequence: Synthetic oligonucleotide
  modified_base (20)..(21): 2'-methoxy-nucleotide
ccgugggaagguagagcuuuu

SEQ ID NO: 2256 - RNA, 21 nt, Artificial Sequence
  Description of Artificial Sequence: Synthetic oligonucleotide
  modified_base (20)..(21): 2'-methoxy-nucleotide
cccgugggaagguagagcuuu

SEQ ID NO: 2257 - RNA, 21 nt, Artificial Sequence
  Description of Artificial Sequence: Synthetic oligonucleotide
  modified_base (20)..(21): 2'-methoxy-nucleotide
ccccgugggaagguagagcuu

SEQ ID NO: 2258 - RNA, 21 nt, Artificial Sequence
  Description of Artificial Sequence: Synthetic oligonucleotide
  modified_base (20)..(21): 2'-methoxy-nucleotide
gccccgugggaagguagaguu

SEQ ID NO: 2259 - RNA, 21 nt, Artificial Sequence
  Description of Artificial Sequence: Synthetic oligonucleotide
  modified_base (20)..(21): 2'-methoxy-nucleotide
ggccccgugggaagguagauu

SEQ ID NO: 2260 - RNA, 21 nt, Artificial Sequence
  Description of Artificial Sequence: Synthetic oligonucleotide
  modified_base (20)..(21): 2'-methoxy-nucleotide
gggccccgugggaagguaguu

SEQ ID NO: 2261 - RNA, 21 nt, Artificial Sequence
  Description of Artificial Sequence: Synthetic oligonucleotide
  modified_base (20)..(21): 2'-methoxy-nucleotide
ggggccccgugggaagguauu

SEQ ID NO: 2262 - RNA, 21 nt, Artificial Sequence
  Description of Artificial Sequence: Synthetic oligonucleotide
  modified_base (20)..(21): 2'-methoxy-nucleotide
cggggccccgugggaagguuu

SEQ ID NO: 2263 - RNA, 21 nt, Artificial Sequence
  Description of Artificial Sequence: Synthetic oligonucleotide
  modified_base (20)..(21): 2'-methoxy-nucleotide
ccggggccccgugggaagguu

SEQ ID NO: 2264 - RNA, 21 nt, Artificial Sequence
  Description of Artificial Sequence: Synthetic oligonucleotide
  modified_base (20)..(21): 2'-methoxy-nucleotide
gccggggccccgugggaaguu

SEQ ID NO: 2265 - RNA, 21 nt, Artificial Sequence
  Description of Artificial Sequence: Synthetic oligonucleotide
  modified_base (20)..(21): 2'-methoxy-nucleotide
cgccggggccccgugggaauu

SEQ ID NO: 2266 - RNA, 21 nt, Artificial Sequence
  Description of Artificial Sequence: Synthetic oligonucleotide
  modified_base (20)..(21): 2'-methoxy-nucleotide
ucgccggggccccgugggauu

SEQ ID NO: 2267 - RNA, 21 nt, Artificial Sequence
  Description of Artificial Sequence: Synthetic oligonucleotide
  modified_base (20)..(21): 2'-methoxy-nucleotide
cucgccggggccccguggguu

SEQ ID NO: 2268 - RNA, 21 nt, Artificial Sequence
  Description of Artificial Sequence: Synthetic oligonucleotide
  modified_base (20)..(21): 2'-methoxy-nucleotide
ccucgccggggccccgugguu

SEQ ID NO: 2269 - RNA, 21 nt, Artificial Sequence
  Description of Artificial Sequence: Synthetic oligonucleotide
  modified_base (20)..(21): 2'-methoxy-nucleotide
gccucgccggggccccguguu

SEQ ID NO: 2270 - RNA, 21 nt, Artificial Sequence
  Description of Artificial Sequence: Synthetic oligonucleotide
  modified_base (20)..(21): 2'-methoxy-nucleotide
ggccucgccggggccccguuu

SEQ ID NO: 2271 - RNA, 21 nt, Artificial Sequence
  Description of Artificial Sequence: Synthetic oligonucleotide
  modified_base (20)..(21): 2'-methoxy-nucleotide
cggccucgccggggccccguu

SEQ ID NO: 2272 - RNA, 21 nt, Artificial Sequence
  Description of Artificial Sequence: Synthetic oligonucleotide
  modified_base (20)..(21): 2'-methoxy-nucleotide
ccggccucgccggggccccuu

SEQ ID NO: 2273 - RNA, 21 nt, Artificial Sequence
  Description of Artificial Sequence: Synthetic oligonucleotide
  modified_base (20)..(21): 2'-methoxy-nucleotide
cccggccucgccggggcccuu

SEQ ID NO: 2274 - RNA, 21 nt, Artificial Sequence
  Description of Artificial Sequence: Synthetic oligonucleotide
  modified_base (20)..(21): 2'-methoxy-nucleotide
ucccggccucgccggggccuu

SEQ ID NO: 2275 - RNA, 21 nt, Artificial Sequence
  Description of Artificial Sequence: Synthetic oligonucleotide
  modified_base (20)..(21): 2'-methoxy-nucleotide
aucccggccucgccggggcuu

SEQ ID NO: 2276 - RNA, 21 nt, Artificial Sequence
  Description of Artificial Sequence: Synthetic oligonucleotide
  modified_base (20)..(21): 2'-methoxy-nucleotide
caucccggccucgccgggguu

SEQ ID NO: 2277 - RNA, 21 nt, Artificial Sequence
  Description of Artificial Sequence: Synthetic oligonucleotide
  modified_base (20)..(21): 2'-methoxy-nucleotide
ucaucccggccucgccggguu

SEQ ID NO: 2278 - RNA, 21 nt, Artificial Sequence
  Description of Artificial Sequence: Synthetic oligonucleotide
  modified_base (20)..(21): 2'-methoxy-nucleotide
cucaucccggccucgccgguu

SEQ ID NO: 2279 - RNA, 21 nt, Artificial Sequence
  Description of Artificial Sequence: Synthetic oligonucleotide
  modified_base (20)..(21): 2'-methoxy-nucleotide
acucaucccggccucgccguu

SEQ ID NO: 2280 - RNA, 21 nt, Artificial Sequence
  Description of Artificial Sequence: Synthetic oligonucleotide
  modified_base (20)..(21): 2'-methoxy-nucleotide
aacucaucccggccucgccuu

SEQ ID NO: 2281 - RNA, 21 nt, Artificial Sequence
  Description of Artificial Sequence: Synthetic oligonucleotide
  modified_base (20)..(21): 2'-methoxy-nucleotide
caacucaucccggccucgcuu

SEQ ID NO: 2282 - RNA, 21 nt, Artificial Sequence
  Description of Artificial Sequence: Synthetic oligonucleotide
  modified_base (20)..(21): 2'-methoxy-nucleotide
ccaacucaucccggccucguu

SEQ ID NO: 2283 - RNA, 21 nt, Artificial Sequence
  Description of Artificial Sequence: Synthetic oligonucleotide
  modified_base (20)..(21): 2'-methoxy-nucleotide
cccaacucaucccggccucuu

SEQ ID NO: 2284 - RNA, 21 nt, Artificial Sequence
  Description of Artificial Sequence: Synthetic oligonucleotide
  modified_base (20)..(21): 2'-methoxy-nucleotide
ucccaacucaucccggccuuu

SEQ ID NO: 2285 - RNA, 21 nt, Artificial Sequence
  Description of Artificial Sequence: Synthetic oligonucleotide
  modified_base (20)..(21): 2'-methoxy-nucleotide
cucccaacucaucccggccuu

SEQ ID NO: 2286 - RNA, 21 nt, Artificial Sequence
  Description of Artificial Sequence: Synthetic oligonucleotide
  modified_base (20)..(21): 2'-methoxy-nucleotide
ccucccaacucaucccggcuu

SEQ ID NO: 2287 - RNA, 21 nt, Artificial Sequence
  Description of Artificial Sequence: Synthetic oligonucleotide
  modified_base (20)..(21): 2'-methoxy-nucleotide
uccucccaacucaucccgguu

SEQ ID NO: 2288 - RNA, 21 nt, Artificial Sequence
  Description of Artificial Sequence: Synthetic oligonucleotide
  modified_base (20)..(21): 2'-methoxy-nucleotide
cuccucccaacucaucccguu

SEQ ID NO: 2289 - RNA, 21 nt, Artificial Sequence
  Description of Artificial Sequence: Synthetic oligonucleotide
  modified_base (20)..(21): 2'-methoxy-nucleotide
ccuccucccaacucaucccuu

SEQ ID NO: 2290 - RNA, 21 nt, Artificial Sequence
  Description of Artificial Sequence: Synthetic oligonucleotide
  modified_base (20)..(21): 2'-methoxy-nucleotide
gccuccucccaacucauccuu

SEQ ID NO: 2291 - RNA, 21 nt, Artificial Sequence
  Description of Artificial Sequence: Synthetic oligonucleotide
  modified_base (20)..(21): 2'-methoxy-nucleotide
ugccuccucccaacucaucuu

SEQ ID NO: 2292 - RNA, 21 nt, Artificial Sequence
  Description of Artificial Sequence: Synthetic oligonucleotide
  modified_base (20)..(21): 2'-methoxy-nucleotide
cugccuccucccaacucauuu

SEQ ID NO: 2293 - RNA, 21 nt, Artificial Sequence
  Description of Artificial Sequence: Synthetic oligonucleotide
  modified_base (20)..(21): 2'-methoxy-nucleotide
ccugccuccucccaacucauu

SEQ ID NO: 2294 - RNA, 21 nt, Artificial Sequence
  Description of Artificial Sequence: Synthetic oligonucleotide
  modified_base (20)..(21): 2'-methoxy-nucleotide
gccugccuccucccaacucuu

SEQ ID NO: 2295 - RNA, 21 nt, Artificial Sequence
  Description of Artificial Sequence: Synthetic oligonucleotide
  modified_base (20)..(21): 2'-methoxy-nucleotide
cgccugccuccucccaacuuu

SEQ ID NO: 2296 - RNA, 21 nt, Artificial Sequence
  Description of Artificial Sequence: Synthetic oligonucleotide
  modified_base (20)..(21): 2'-methoxy-nucleotide
ccgccugccuccucccaacuu

SEQ ID NO: 2297 - RNA, 21 nt, Artificial Sequence
  Description of Artificial Sequence: Synthetic oligonucleotide
  modified_base (20)..(21): 2'-methoxy-nucleotide
gccgccugccuccucccaauu

SEQ ID NO: 2298 - RNA, 21 nt, Artificial Sequence
  Description of Artificial Sequence: Synthetic oligonucleotide
  modified_base (20)..(21): 2'-methoxy-nucleotide
ggccgccugccuccucccauu

SEQ ID NO: 2299 - RNA, 21 nt, Artificial Sequence
  Description of Artificial Sequence: Synthetic oligonucleotide
  modified_base (20)..(21): 2'-methoxy-nucleotide
aggccgccugccuccucccuu

SEQ ID NO: 2300 - RNA, 21 nt, Artificial Sequence
  Description of Artificial Sequence: Synthetic oligonucleotide
  modified_base (20)..(21): 2'-methoxy-nucleotide
caggccgccugccuccuccuu

SEQ ID NO: 2301 - RNA, 21 nt, Artificial Sequence
  Description of Artificial Sequence: Synthetic oligonucleotide
  modified_base (20)..(21): 2'-methoxy-nucleotide
ccaggccgccugccuccucuu

SEQ ID NO: 2302 - RNA, 21 nt, Artificial Sequence
  Description of Artificial Sequence: Synthetic oligonucleotide
  modified_base (20)..(21): 2'-methoxy-nucleotide
gccaggccgccugccuccuuu

SEQ ID NO: 2303 - RNA, 21 nt, Artificial Sequence
  Description of Artificial Sequence: Synthetic oligonucleotide
  modified_base (20)..(21): 2'-methoxy-nucleotide
ugccaggccgccugccuccuu

SEQ ID NO: 2304 - RNA, 21 nt, Artificial Sequence
  Description of Artificial Sequence: Synthetic oligonucleotide
  modified_base (20)..(21): 2'-methoxy-nucleotide
gugccaggccgccugccucuu

SEQ ID NO: 2305 - RNA, 21 nt, Artificial Sequence
  Description of Artificial Sequence: Synthetic oligonucleotide
  modified_base (20)..(21): 2'-methoxy-nucleotide
ggugccaggccgccugccuuu

SEQ ID NO: 2306 - RNA, 21 nt, Artificial Sequence
  Description of Artificial Sequence: Synthetic oligonucleotide
  modified_base (20)..(21): 2'-methoxy-nucleotide
aggugccaggccgccugccuu

SEQ ID NO: 2307 - RNA, 21 nt, Artificial Sequence
  Description of Artificial Sequence: Synthetic oligonucleotide
  modified_base (20)..(21): 2'-methoxy-nucleotide
gaggugccaggccgccugcuu

SEQ ID NO: 2308 - RNA, 21 nt, Artificial Sequence
  Description of Artificial Sequence: Synthetic oligonucleotide
  modified_base (20)..(21): 2'-methoxy-nucleotide
ugaggugccaggccgccuguu

SEQ ID NO: 2309 - RNA, 21 nt, Artificial Sequence
  Description of Artificial Sequence: Synthetic oligonucleotide
  modified_base (20)..(21): 2'-methoxy-nucleotide
gugaggugccaggccgccuuu

SEQ ID NO: 2310 - RNA, 21 nt, Artificial Sequence
  Description of Artificial Sequence: Synthetic oligonucleotide
  modified_base (20)..(21): 2'-methoxy-nucleotide
ggugaggugccaggccgccuu

SEQ ID NO: 2311 - RNA, 21 nt, Artificial Sequence
  Description of Artificial Sequence: Synthetic oligonucleotide
  modified_base (20)..(21): 2'-methoxy-nucleotide
aggugaggugccaggccgcuu

SEQ ID NO: 2312 - RNA, 21 nt, Artificial Sequence
  Description of Artificial Sequence: Synthetic oligonucleotide
  modified_base (20)..(21): 2'-methoxy-nucleotide
caggugaggugccaggccguu

SEQ ID NO: 2313 - RNA, 21 nt, Artificial Sequence
  Description of Artificial Sequence: Synthetic oligonucleotide
  modified_base (20)..(21): 2'-methoxy-nucleotide
gcaggugaggugccaggccuu

SEQ ID NO: 2314 - RNA, 21 nt, Artificial Sequence
  Description of Artificial Sequence: Synthetic oligonucleotide
  modified_base (20)..(21): 2'-methoxy-nucleotide
agcaggugaggugccaggcuu

SEQ ID NO: 2315 - RNA, 21 nt, Artificial Sequence
  Description of Artificial Sequence: Synthetic oligonucleotide
  modified_base (20)..(21): 2'-methoxy-nucleotide
gagcaggugaggugccagguu

SEQ ID NO: 2316 - RNA, 21 nt, Artificial Sequence
  Description of Artificial Sequence: Synthetic oligonucleotide
  modified_base (20)..(21): 2'-methoxy-nucleotide
agagcaggugaggugccaguu

SEQ ID NO: 2317 - RNA, 21 nt, Artificial Sequence
  Description of Artificial Sequence: Synthetic oligonucleotide
  modified_base (20)..(21): 2'-methoxy-nucleotide
cagagcaggugaggugccauu

SEQ ID NO: 2318 - RNA, 21 nt, Artificial Sequence
  Description of Artificial Sequence: Synthetic oligonucleotide
  modified_base (20)..(21): 2'-methoxy-nucleotide
gcagagcaggugaggugccuu

SEQ ID NO: 2319 - RNA, 21 nt, Artificial Sequence
  Description of Artificial Sequence: Synthetic oligonucleotide
  modified_base (20)..(21): 2'-methoxy-nucleotide
agcagagcaggugaggugcuu

SEQ ID NO: 2320 - RNA, 21 nt, Artificial Sequence
  Description of Artificial Sequence: Synthetic oligonucleotide
  modified_base (20)..(21): 2'-methoxy-nucleotide
cagcagagcaggugagguguu

SEQ ID NO: 2321 - RNA, 21 nt, Artificial Sequence
  Description of Artificial Sequence: Synthetic oligonucleotide
  modified_base (20)..(21): 2'-methoxy-nucleotide
gcagcagagcaggugagguuu

SEQ ID NO: 2322 - RNA, 21 nt, Artificial Sequence
  Description of Artificial Sequence: Synthetic oligonucleotide
  modified_base (20)..(21): 2'-methoxy-nucleotide
ugcagcagagcaggugagguu

SEQ ID NO: 2323 - RNA, 21 nt, Artificial Sequence
  Description of Artificial Sequence: Synthetic oligonucleotide
  modified_base (20)..(21): 2'-methoxy-nucleotide
cugcagcagagcaggugaguu

SEQ ID NO: 2324 - RNA, 21 nt, Artificial Sequence
  Description of Artificial Sequence: Synthetic oligonucleotide
  modified_base (20)..(21): 2'-methoxy-nucleotide
ccugcagcagagcaggugauu

SEQ ID NO: 2325 - RNA, 21 nt, Artificial Sequence
  Description of Artificial Sequence: Synthetic oligonucleotide
  modified_base (20)..(21): 2'-methoxy-nucleotide
cccugcagcagagcagguguu

SEQ ID NO: 2326 - RNA, 21 nt, Artificial Sequence
  Description of Artificial Sequence: Synthetic oligonucleotide
  modified_base (20)..(21): 2'-methoxy-nucleotide
ccccugcagcagagcagguuu

SEQ ID NO: 2327 - RNA, 21 nt, Artificial Sequence
  Description of Artificial Sequence: Synthetic oligonucleotide
  modified_base (20)..(21): 2'-methoxy-nucleotide
uccccugcagcagagcagguu

SEQ ID NO: 2328 - RNA, 21 nt, Artificial Sequence
  Description of Artificial Sequence: Synthetic oligonucleotide
  modified_base (20)..(21): 2'-methoxy-nucleotide
guccccugcagcagagcaguu

SEQ ID NO: 2329 - RNA, 21 nt, Artificial Sequence
  Description of Artificial Sequence: Synthetic oligonucleotide
  modified_base (20)..(21): 2'-methoxy-nucleotide
uguccccugcagcagagcauu

SEQ ID NO: 2330 - RNA, 21 nt, Artificial Sequence
  Description of Artificial Sequence: Synthetic oligonucleotide
  modified_base (20)..(21): 2'-methoxy-nucleotide
cuguccccugcagcagagcuu

SEQ ID NO: 2331 - RNA, 21 nt, Artificial Sequence
  Description of Artificial Sequence: Synthetic oligonucleotide
  modified_base (20)..(21): 2'-methoxy-nucleotide
gcuguccccugcagcagaguu

SEQ ID NO: 2332 - RNA, 21 nt, Artificial Sequence
  Description of Artificial Sequence: Synthetic oligonucleotide
  modified_base (20)..(21): 2'-methoxy-nucleotide
ugcuguccccugcagcagauu

SEQ ID NO: 2333 - RNA, 21 nt, Artificial Sequence
  Description of Artificial Sequence: Synthetic oligonucleotide
  modified_base (20)..(21): 2'-methoxy-nucleotide
cugcuguccccugcagcaguu

SEQ ID NO: 2334 - RNA, 21 nt, Artificial Sequence
  Description of Artificial Sequence: Synthetic oligonucleotide
  modified_base (20)..(21): 2'-methoxy-nucleotide
ucugcuguccccugcagcauu

SEQ ID NO: 2335 - RNA, 21 nt, Artificial Sequence
  Description of Artificial Sequence: Synthetic oligonucleotide
  modified_base (20)..(21): 2'-methoxy-nucleotide
cucugcuguccccugcagcuu

SEQ ID NO: 2336 - RNA, 21 nt, Artificial Sequence
  Description of Artificial Sequence: Synthetic oligonucleotide
  modified_base (20)..(21): 2'-methoxy-nucleotide
ccucugcuguccccugcaguu

SEQ ID NO: 2337 - RNA, 21 nt, Artificial Sequence
  Description of Artificial Sequence: Synthetic oligonucleotide
  modified_base (20)..(21): 2'-methoxy-nucleotide
uccucugcuguccccugcauu

SEQ ID NO: 2338 - RNA, 21 nt, Artificial Sequence
  Description of Artificial Sequence: Synthetic oligonucleotide
  modified_base (20)..(21): 2'-methoxy-nucleotide
uuccucugcuguccccugcuu

SEQ ID NO: 2339 - RNA, 21 nt, Artificial Sequence
  Description of Artificial Sequence: Synthetic oligonucleotide
  modified_base (20)..(21): 2'-methoxy-nucleotide
cuuccucugcuguccccuguu

SEQ ID NO: 2340 - RNA, 21 nt, Artificial Sequence
  Description of Artificial Sequence: Synthetic oligonucleotide
  modified_base (20)..(21): 2'-methoxy-nucleotide
ucuuccucugcuguccccuuu

SEQ ID NO: 2341 - RNA, 21 nt, Artificial Sequence
  Description of Artificial Sequence: Synthetic oligonucleotide
  modified_base (20)..(21): 2'-methoxy-nucleotide
gucuuccucugcuguccccuu

SEQ ID NO: 2342 - RNA, 21 nt, Artificial Sequence
  Description of Artificial Sequence: Synthetic oligonucleotide
  modified_base (20)..(21): 2'-methoxy-nucleotide
ggucuuccucugcugucccuu

SEQ ID NO: 2343 - RNA, 21 nt, Artificial Sequence
  Description of Artificial Sequence: Synthetic oligonucleotide
  modified_base (20)..(21): 2'-methoxy-nucleotide
uggucuuccucugcuguccuu

SEQ ID NO: 2344 - RNA, 21 nt, Artificial Sequence
  Description of Artificial Sequence: Synthetic oligonucleotide
  modified_base (20)..(21): 2'-methoxy-nucleotide
auggucuuccucugcugucuu

SEQ ID NO: 2345 - RNA, 21 nt, Artificial Sequence
  Description of Artificial Sequence: Synthetic oligonucleotide
  modified_base (20)..(21): 2'-methoxy-nucleotide
cauggucuuccucugcuguuu

SEQ ID NO: 2346 - RNA, 21 nt, Artificial Sequence
  Description of Artificial Sequence: Synthetic oligonucleotide
  modified_base (20)..(21): 2'-methoxy-nucleotide
acauggucuuccucugcuguu

SEQ ID NO: 2347 - RNA, 21 nt, Artificial Sequence
  Description of Artificial Sequence: Synthetic oligonucleotide
  modified_base (20)..(21): 2'-methoxy-nucleotide
cacauggucuuccucugcuuu

SEQ ID NO: 2348 - RNA, 21 nt, Artificial Sequence
  Description of Artificial Sequence: Synthetic oligonucleotide
  modified_base (20)..(21): 2'-methoxy-nucleotide
ccacauggucuuccucugcuu

SEQ ID NO: 2349 - RNA, 21 nt, Artificial Sequence
  Description of Artificial Sequence: Synthetic oligonucleotide
  modified_base (20)..(21): 2'-methoxy-nucleotide
uccacauggucuuccucuguu

SEQ ID NO: 2350 - RNA, 21 nt, Artificial Sequence
  Description of Artificial Sequence: Synthetic oligonucleotide
  modified_base (20)..(21): 2'-methoxy-nucleotide
guccacauggucuuccucuuu

SEQ ID NO: 2351 - RNA, 21 nt, Artificial Sequence
  Description of Artificial Sequence: Synthetic oligonucleotide
  modified_base (20)..(21): 2'-methoxy-nucleotide
gguccacauggucuuccucuu

SEQ ID NO: 2352 - RNA, 21 nt, Artificial Sequence
  Description of Artificial Sequence: Synthetic oligonucleotide
  modified_base (20)..(21): 2'-methoxy-nucleotide
agguccacauggucuuccuuu

SEQ ID NO: 2353 - RNA, 21 nt, Artificial Sequence
  Description of Artificial Sequence: Synthetic oligonucleotide
  modified_base (20)..(21): 2'-methoxy-nucleotide
cagguccacauggucuuccuu

SEQ ID NO: 2354 - RNA, 21 nt, Artificial Sequence
  Description of Artificial Sequence: Synthetic oligonucleotide
  modified_base (20)..(21): 2'-methoxy-nucleotide
acagguccacauggucuucuu

SEQ ID NO: 2355 - RNA, 21 nt, Artificial Sequence
  Description of Artificial Sequence: Synthetic oligonucleotide
  modified_base (20)..(21): 2'-methoxy-nucleotide
gacagguccacauggucuuuu

SEQ ID NO: 2356 - RNA, 21 nt, Artificial Sequence
  Description of Artificial Sequence: Synthetic oligonucleotide
  modified_base (20)..(21): 2'-methoxy-nucleotide
ugacagguccacauggucuuu

SEQ ID NO: 2357 - RNA, 21 nt, Artificial Sequence
  Description of Artificial Sequence: Synthetic oligonucleotide
  modified_base (20)..(21): 2'-methoxy-nucleotide
gugacagguccacauggucuu

SEQ ID NO: 2358 - RNA, 21 nt, Artificial Sequence
  Description of Artificial Sequence: Synthetic oligonucleotide
  modified_base (20)..(21): 2'-methoxy-nucleotide
agugacagguccacaugguuu

SEQ ID NO: 2359 - RNA, 21 nt, Artificial Sequence
  Description of Artificial Sequence: Synthetic oligonucleotide
  modified_base (20)..(21): 2'-methoxy-nucleotide
cagugacagguccacaugguu

SEQ ID NO: 2360 - RNA, 21 nt, Artificial Sequence
  Description of Artificial Sequence: Synthetic oligonucleotide
  modified_base (20)..(21): 2'-methoxy-nucleotide
acagugacagguccacauguu

SEQ ID NO: 2361 - RNA, 21 nt, Artificial Sequence
  Description of Artificial Sequence: Synthetic oligonucleotide
  modified_base (20)..(21): 2'-methoxy-nucleotide
gacagugacagguccacauuu

SEQ ID NO: 2362 - RNA, 21 nt, Artificial Sequence
  Description of Artificial Sequence: Synthetic oligonucleotide
  modified_base (20)..(21): 2'-methoxy-nucleotide
agacagugacagguccacauu

SEQ ID NO: 2363 - RNA, 21 nt, Artificial Sequence
  Description of Artificial Sequence: Synthetic oligonucleotide
  modified_base (20)..(21): 2'-methoxy-nucleotide
aagacagugacagguccacuu

SEQ ID NO: 2364 - RNA, 21 nt, Artificial Sequence
  Description of Artificial Sequence: Synthetic oligonucleotide
  modified_base (20)..(21): 2'-methoxy-nucleotide
caagacagugacagguccauu

SEQ ID NO: 2365 - RNA, 21 nt, Artificial Sequence
  Description of Artificial Sequence: Synthetic oligonucleotide
  modified_base (20)..(21): 2'-methoxy-nucleotide
acaagacagugacagguccuu

SEQ ID NO: 2366 - RNA, 21 nt, Artificial Sequence
  Description of Artificial Sequence: Synthetic oligonucleotide
  modified_base (20)..(21): 2'-methoxy-nucleotide
uacaagacagugacaggucuu

SEQ ID NO: 2367 - RNA, 21 nt, Artificial Sequence
  Description of Artificial Sequence: Synthetic oligonucleotide
  modified_base (20)..(21): 2'-methoxy-nucleotide
guacaagacagugacagguuu

SEQ ID NO: 2368 - RNA, 21 nt, Artificial Sequence
  Description of Artificial Sequence: Synthetic oligonucleotide
  modified_base (20)..(21): 2'-methoxy-nucleotide
gguacaagacagugacagguu

SEQ ID NO: 2369 - RNA, 21 nt, Artificial Sequence
  Description of Artificial Sequence: Synthetic oligonucleotide
  modified_base (20)..(21): 2'-methoxy-nucleotide
ggguacaagacagugacaguu

SEQ ID NO: 2370 - RNA, 21 nt, Artificial Sequence
  Description of Artificial Sequence: Synthetic oligonucleotide
  modified_base (20)..(21): 2'-methoxy-nucleotide
aggguacaagacagugacauu

SEQ ID NO: 2371 - RNA, 21 nt, Artificial Sequence
  Description of Artificial Sequence: Synthetic oligonucleotide
  modified_base (20)..(21): 2'-methoxy-nucleotide
aaggguacaagacagugacuu

SEQ ID NO: 2372 - RNA, 21 nt, Artificial Sequence
  Description of Artificial Sequence: Synthetic oligonucleotide
  modified_base (20)..(21): 2'-methoxy-nucleotide
caaggguacaagacagugauu

SEQ ID NO: 2373 - RNA, 21 nt, Artificial Sequence
  Description of Artificial Sequence: Synthetic oligonucleotide
  modified_base (20)..(21): 2'-methoxy-nucleotide
acaaggguacaagacaguguu

SEQ ID NO: 2374 - RNA, 21 nt, Artificial Sequence
  Description of Artificial Sequence: Synthetic oligonucleotide
  modified_base (20)..(21): 2'-methoxy-nucleotide
cacaaggguacaagacaguuu

SEQ ID NO: 2375 - RNA, 21 nt, Artificial Sequence
  Description of Artificial Sequence: Synthetic oligonucleotide
  modified_base (20)..(21): 2'-methoxy-nucleotide
gcacaaggguacaagacaguu

SEQ ID NO: 2376 - RNA, 21 nt, Artificial Sequence
  Description of Artificial Sequence: Synthetic oligonucleotide
  modified_base (20)..(21): 2'-methoxy-nucleotide
ggcacaaggguacaagacauu

SEQ ID NO: 2377 - RNA, 21 nt, Artificial Sequence
  Description of Artificial Sequence: Synthetic oligonucleotide
  modified_base (20)..(21): 2'-methoxy-nucleotide
aggcacaaggguacaagacuu

SEQ ID NO: 2378 - RNA, 21 nt, Artificial Sequence
  Description of Artificial Sequence: Synthetic oligonucleotide
  modified_base (20)..(21): 2'-methoxy-nucleotide
gaggcacaaggguacaagauu

SEQ ID NO: 2379 - RNA, 21 nt, Artificial Sequence
  Description of Artificial Sequence: Synthetic oligonucleotide
  modified_base (20)..(21): 2'-methoxy-nucleotide
cgaggcacaaggguacaaguu

SEQ ID NO: 2380 - RNA, 21 nt, Artificial Sequence
  Description of Artificial Sequence: Synthetic oligonucleotide
  modified_base (20)..(21): 2'-methoxy-nucleotide
gcgaggcacaaggguacaauu

SEQ ID NO: 2381 - RNA, 21 nt, Artificial Sequence
  Description of Artificial Sequence: Synthetic oligonucleotide
  modified_base (20)..(21): 2'-methoxy-nucleotide
agcgaggcacaaggguacauu

SEQ ID NO: 2382 - RNA, 21 nt, Artificial Sequence
  Description of Artificial Sequence: Synthetic oligonucleotide
  modified_base (20)..(21): 2'-methoxy-nucleotide
gagcgaggcacaaggguacuu

SEQ ID NO: 2383 - RNA, 21 nt, Artificial Sequence
  Description of Artificial Sequence: Synthetic oligonucleotide
  modified_base (20)..(21): 2'-methoxy-nucleotide
ugagcgaggcacaaggguauu

SEQ ID NO: 2384 - RNA, 21 nt, Artificial Sequence
  Description of Artificial Sequence: Synthetic oligonucleotide
  modified_base (20)..(21): 2'-methoxy-nucleotide
cugagcgaggcacaaggguuu

SEQ ID NO: 2385 - RNA, 21 nt, Artificial Sequence
  Description of Artificial Sequence: Synthetic oligonucleotide
  modified_base (20)..(21): 2'-methoxy-nucleotide
ccugagcgaggcacaaggguu

SEQ ID NO: 2386 - RNA, 21 nt, Artificial Sequence
  Description of Artificial Sequence: Synthetic oligonucleotide
  modified_base (20)..(21): 2'-methoxy-nucleotide
cccugagcgaggcacaagguu

SEQ ID NO: 2387 - RNA, 21 nt, Artificial Sequence
  Description of Artificial Sequence: Synthetic oligonucleotide
  modified_base (20)..(21): 2'-methoxy-nucleotide
ccccugagcgaggcacaaguu

SEQ ID NO: 2388 - RNA, 21 nt, Artificial Sequence
  Description of Artificial Sequence: Synthetic oligonucleotide
  modified_base (20)..(21): 2'-methoxy-nucleotide
uccccugagcgaggcacaauu

SEQ ID NO: 2389 - RNA, 21 nt, Artificial Sequence
  Description of Artificial Sequence: Synthetic oligonucleotide
  modified_base (20)..(21): 2'-methoxy-nucleotide
cuccccugagcgaggcacauu

SEQ ID NO: 2390 - RNA, 21 nt, Artificial Sequence
  Description of Artificial Sequence: Synthetic oligonucleotide
  modified_base (20)..(21): 2'-methoxy-nucleotide
gcuccccugagcgaggcacuu

SEQ ID NO: 2391 - RNA, 21 nt, Artificial Sequence
  Description of Artificial Sequence: Synthetic oligonucleotide
  modified_base (20)..(21): 2'-methoxy-nucleotide
ugcuccccugagcgaggcauu

SEQ ID NO: 2392 - RNA, 21 nt, Artificial Sequence
  Description of Artificial Sequence: Synthetic oligonucleotide
  modified_base (20)..(21): 2'-methoxy-nucleotide
cugcuccccugagcgaggcuu

SEQ ID NO: 2393 - RNA, 21 nt, Artificial Sequence
  Description of Artificial Sequence: Synthetic oligonucleotide
  modified_base (20)..(21): 2'-methoxy-nucleotide
ccugcuccccugagcgagguu

SEQ ID NO: 2394 - RNA, 21 nt, Artificial Sequence
  Description of Artificial Sequence: Synthetic oligonucleotide
  modified_base (20)..(21): 2'-methoxy-nucleotide
gccugcuccccugagcgaguu

SEQ ID NO: 2395 - RNA, 21 nt, Artificial Sequence
  Description of Artificial Sequence: Synthetic oligonucleotide
  modified_base (20)..(21): 2'-methoxy-nucleotide
agccugcuccccugagcgauu

SEQ ID NO: 2396 - RNA, 21 nt, Artificial Sequence
  Description of Artificial Sequence: Synthetic oligonucleotide
  modified_base (20)..(21): 2'-methoxy-nucleotide
cagccugcuccccugagcguu

SEQ ID NO: 2397 - RNA, 21 nt, Artificial Sequence
  Description of Artificial Sequence: Synthetic oligonucleotide
  modified_base (20)..(21): 2'-methoxy-nucleotide
ucagccugcuccccugagcuu

SEQ ID NO: 2398 - RNA, 21 nt, Artificial Sequence
  Description of Artificial Sequence: Synthetic oligonucleotide
  modified_base (20)..(21): 2'-methoxy-nucleotide
uucagccugcuccccugaguu

SEQ ID NO: 2399 - RNA, 21 nt, Artificial Sequence
  Description of Artificial Sequence: Synthetic oligonucleotide
  modified_base (20)..(21): 2'-methoxy-nucleotide
cuucagccugcuccccugauu

SEQ ID NO: 2400 - RNA, 21 nt, Artificial Sequence
  Description of Artificial Sequence: Synthetic oligonucleotide
  modified_base (20)..(21): 2'-methoxy-nucleotide
ccuucagccugcuccccuguu

SEQ ID NO: 2401 - RNA, 21 nt, Artificial Sequence
  Description of Artificial Sequence: Synthetic oligonucleotide
  modified_base (20)..(21): 2'-methoxy-nucleotide
cccuucagccugcuccccuuu

SEQ ID NO: 2402 - RNA, 21 nt, Artificial Sequence
  Description of Artificial Sequence: Synthetic oligonucleotide
  modified_base (20)..(21): 2'-methoxy-nucleotide
acccuucagccugcuccccuu

SEQ ID NO: 2403 - RNA, 21 nt, Artificial Sequence
  Description of Artificial Sequence: Synthetic oligonucleotide
  modified_base (20)..(21): 2'-methoxy-nucleotide
gacccuucagccugcucccuu

SEQ ID NO: 2404 - RNA, 21 nt, Artificial Sequence
  Description of Artificial Sequence: Synthetic oligonucleotide
  modified_base (20)..(21): 2'-methoxy-nucleotide
ggacccuucagccugcuccuu

SEQ ID NO: 2405 - RNA, 21 nt, Artificial Sequence
  Description of Artificial Sequence: Synthetic oligonucleotide
  modified_base (20)..(21): 2'-methoxy-nucleotide
gggacccuucagccugcucuu

SEQ ID NO: 2406 - RNA, 21 nt, Artificial Sequence
  Description of Artificial Sequence: Synthetic oligonucleotide
  modified_base (20)..(21): 2'-methoxy-nucleotide
ggggacccuucagccugcuuu

SEQ ID NO: 2407 - RNA, 21 nt, Artificial Sequence
  Description of Artificial Sequence: Synthetic oligonucleotide
  modified_base (20)..(21): 2'-methoxy-nucleotide
uggggacccuucagccugcuu

SEQ ID NO: 2408 - RNA, 21 nt, Artificial Sequence
  Description of Artificial Sequence: Synthetic oligonucleotide
  modified_base (20)..(21): 2'-methoxy-nucleotide
cuggggacccuucagccuguu

SEQ ID NO: 2409 - RNA, 21 nt, Artificial Sequence
  Description of Artificial Sequence: Synthetic oligonucleotide
  modified_base (20)..(21): 2'-methoxy-nucleotide
ccuggggacccuucagccuuu

SEQ ID NO: 2410 - RNA, 21 nt, Artificial Sequence
  Description of Artificial Sequence: Synthetic oligonucleotide
  modified_base (20)..(21): 2'-methoxy-nucleotide
accuggggacccuucagccuu

SEQ ID NO: 2411 - RNA, 21 nt, Artificial Sequence
  Description of Artificial Sequence: Synthetic oligonucleotide
  modified_base (20)..(21): 2'-methoxy-nucleotide
caccuggggacccuucagcuu

SEQ ID NO: 2412 - RNA, 21 nt, Artificial Sequence
  Description of Artificial Sequence: Synthetic oligonucleotide
  modified_base (20)..(21): 2'-methoxy-nucleotide
ccaccuggggacccuucaguu

SEQ ID NO: 2413 - RNA, 21 nt, Artificial Sequence
  Description of Artificial Sequence: Synthetic oligonucleotide
  modified_base (20)..(21): 2'-methoxy-nucleotide
uccaccuggggacccuucauu

SEQ ID NO: 2414 - RNA, 21 nt, Artificial Sequence
  Description of Artificial Sequence: Synthetic oligonucleotide
  modified_base (20)..(21): 2'-methoxy-nucleotide
guccaccuggggacccuucuu

SEQ ID NO: 2415 - RNA, 21 nt, Artificial Sequence
  Description of Artificial Sequence: Synthetic oligonucleotide
  modified_base (20)..(21): 2'-methoxy-nucleotide
gguccaccuggggacccuuuu

SEQ ID NO: 2416 - RNA, 21 nt, Artificial Sequence
  Description of Artificial Sequence: Synthetic oligonucleotide
  modified_base (20)..(21): 2'-methoxy-nucleotide
agguccaccuggggacccuuu

SEQ ID NO: 2417 - RNA, 21 nt, Artificial Sequence
  Description of Artificial Sequence: Synthetic oligonucleotide
  modified_base (20)..(21): 2'-methoxy-nucleotide
cagguccaccuggggacccuu

SEQ ID NO: 2418 - RNA, 21 nt, Artificial Sequence
  Description of Artificial Sequence: Synthetic oligonucleotide
  modified_base (20)..(21): 2'-methoxy-nucleotide
ccagguccaccuggggaccuu

SEQ ID NO: 2419 - RNA, 21 nt, Artificial Sequence
  Description of Artificial Sequence: Synthetic oligonucleotide
  modified_base (20)..(21): 2'-methoxy-nucleotide
uccagguccaccuggggacuu

SEQ ID NO: 2420 - RNA, 21 nt, Artificial Sequence
  Description of Artificial Sequence: Synthetic oligonucleotide
  modified_base (20)..(21): 2'-methoxy-nucleotide
cuccagguccaccuggggauu

SEQ ID NO: 2421 - RNA, 21 nt, Artificial Sequence
  Description of Artificial Sequence: Synthetic oligonucleotide
  modified_base (20)..(21): 2'-methoxy-nucleotide
ucuccagguccaccugggguu

SEQ ID NO: 2422 - RNA, 21 nt, Artificial Sequence
  Description of Artificial Sequence: Synthetic oligonucleotide
  modified_base (20)..(21): 2'-methoxy-nucleotide
gucuccagguccaccuggguu

SEQ ID NO: 2423 - RNA, 21 nt, Artificial Sequence
  Description of Artificial Sequence: Synthetic oligonucleotide
  modified_base (20)..(21): 2'-methoxy-nucleotide
agucuccagguccaccugguu

SEQ ID NO: 2424 - RNA, 21 nt, Artificial Sequence
  Description of Artificial Sequence: Synthetic oligonucleotide
  modified_base (20)..(21): 2'-methoxy-nucleotide
gagucuccagguccaccuguu

SEQ ID NO: 2425 - RNA, 21 nt, Artificial Sequence
  Description of Artificial Sequence: Synthetic oligonucleotide
  modified_base (20)..(21): 2'-methoxy-nucleotide
agagucuccagguccaccuuu

SEQ ID NO: 2426 - RNA, 21 nt, Artificial Sequence
  Description of Artificial Sequence: Synthetic oligonucleotide
  modified_base (20)..(21): 2'-methoxy-nucleotide
gagagucuccagguccaccuu

SEQ ID NO: 2427 - RNA, 21 nt, Artificial Sequence
  Description of Artificial Sequence: Synthetic oligonucleotide
  modified_base (20)..(21): 2'-methoxy-nucleotide
ugagagucuccagguccacuu

SEQ ID NO: 2428 - RNA, 21 nt, Artificial Sequence
  Description of Artificial Sequence: Synthetic oligonucleotide
  modified_base (20)..(21): 2'-methoxy-nucleotide
cugagagucuccagguccauu

SEQ ID NO: 2429 - RNA, 21 nt, Artificial Sequence
  Description of Artificial Sequence: Synthetic oligonucleotide
  modified_base (20)..(21): 2'-methoxy-nucleotide
ccugagagucuccagguccuu

SEQ ID NO: 2430 - RNA, 21 nt, Artificial Sequence
  Description of Artificial Sequence: Synthetic oligonucleotide
  modified_base (20)..(21): 2'-methoxy-nucleotide
cccugagagucuccaggucuu

SEQ ID NO: 2431 - RNA, 21 nt, Artificial Sequence
  Description of Artificial Sequence: Synthetic oligonucleotide
  modified_base (20)..(21): 2'-methoxy-nucleotide
acccugagagucuccagguuu

SEQ ID NO: 2432 - RNA, 21 nt, Artificial Sequence
  Description of Artificial Sequence: Synthetic oligonucleotide
  modified_base (20)..(21): 2'-methoxy-nucleotide
gacccugagagucuccagguu

SEQ ID NO: 2433 - RNA, 21 nt, Artificial Sequence
  Description of Artificial Sequence: Synthetic oligonucleotide
  modified_base (20)..(21): 2'-methoxy-nucleotide
cgacccugagagucuccaguu

SEQ ID NO: 2434 - RNA, 21 nt, Artificial Sequence
  Description of Artificial Sequence: Synthetic oligonucleotide
  modified_base (20)..(21): 2'-methoxy-nucleotide
ucgacccugagagucuccauu

SEQ ID NO: 2435 - RNA, 21 nt, Artificial Sequence
  Description of Artificial Sequence: Synthetic oligonucleotide
  modified_base (20)..(21): 2'-methoxy-nucleotide
uucgacccugagagucuccuu

SEQ ID NO: 2436 - RNA, 21 nt, Artificial Sequence
  Description of Artificial Sequence: Synthetic oligonucleotide
  modified_base (20)..(21): 2'-methoxy-nucleotide
uuucgacccugagagucucuu

SEQ ID NO: 2437 - RNA, 21 nt, Artificial Sequence
  Description of Artificial Sequence: Synthetic oligonucleotide
  modified_base (20)..(21): 2'-methoxy-nucleotide
uuuucgacccugagagucuuu

SEQ ID NO: 2438 - RNA, 21 nt, Artificial Sequence
  Description of Artificial Sequence: Synthetic oligonucleotide
  modified_base (20)..(21): 2'-methoxy-nucleotide
guuuucgacccugagagucuu

SEQ ID NO: 2439 - RNA, 21 nt, Artificial Sequence
  Description of Artificial Sequence: Synthetic oligonucleotide
  modified_base (20)..(21): 2'-methoxy-nucleotide
cguuuucgacccugagaguuu

SEQ ID NO: 2440 - RNA, 21 nt, Artificial Sequence
  Description of Artificial Sequence: Synthetic oligonucleotide
  modified_base (20)..(21): 2'-methoxy-nucleotide
ccguuuucgacccugagaguu

SEQ ID NO: 2441 - RNA, 21 nt, Artificial Sequence
  Description of Artificial Sequence: Synthetic oligonucleotide
  modified_base (20)..(21): 2'-methoxy-nucleotide
gccguuuucgacccugagauu

SEQ ID NO: 2442 - RNA, 21 nt, Artificial Sequence
  Description of Artificial Sequence: Synthetic oligonucleotide
  modified_base (20)..(21): 2'-methoxy-nucleotide
cgccguuuucgacccugaguu

SEQ ID NO: 2443 - RNA, 21 nt, Artificial Sequence
  Description of Artificial Sequence: Synthetic oligonucleotide
  modified_base (20)..(21): 2'-methoxy-nucleotide
ccgccguuuucgacccugauu

SEQ ID NO: 2444 - RNA, 21 nt, Artificial Sequence
  Description of Artificial Sequence: Synthetic oligonucleotide
  modified_base (20)..(21): 2'-methoxy-nucleotide
gccgccguuuucgacccuguu

SEQ ID NO: 2445 - RNA, 21 nt, Artificial Sequence
  Description of Artificial Sequence: Synthetic oligonucleotide
  modified_base (20)..(21): 2'-methoxy-nucleotide
ugccgccguuuucgacccuuu

SEQ ID NO: 2446 - RNA, 21 nt, Artificial Sequence
  Description of Artificial Sequence: Synthetic oligonucleotide
  modified_base (20)..(21): 2'-methoxy-nucleotide
cugccgccguuuucgacccuu

SEQ ID NO: 2447 - RNA, 21 nt, Artificial Sequence
  Description of Artificial Sequence: Synthetic oligonucleotide
  modified_base (20)..(21): 2'-methoxy-nucleotide
ucugccgccguuuucgaccuu

SEQ ID NO: 2448 - RNA, 21 nt, Artificial Sequence
  Description of Artificial Sequence: Synthetic oligonucleotide
  modified_base (20)..(21): 2'-methoxy-nucleotide
gucugccgccguuuucgacuu

SEQ ID NO: 2449 - RNA, 21 nt, Artificial Sequence
  Description of Artificial Sequence: Synthetic oligonucleotide
  modified_base (20)..(21): 2'-methoxy-nucleotide
ggucugccgccguuuucgauu

SEQ ID NO: 2450 - RNA, 21 nt, Artificial Sequence
  Description of Artificial Sequence: Synthetic oligonucleotide
  modified_base (20)..(21): 2'-methoxy-nucleotide
uggucugccgccguuuucguu

SEQ ID NO: 2451 - RNA, 21 nt, Artificial Sequence
  Description of Artificial Sequence: Synthetic oligonucleotide
  modified_base (20)..(21): 2'-methoxy-nucleotide
cuggucugccgccguuuucuu

SEQ ID NO: 2452 - RNA, 21 nt, Artificial Sequence
  Description of Artificial Sequence: Synthetic oligonucleotide
  modified_base (20)..(21): 2'-methoxy-nucleotide
gcuggucugccgccguuuuuu

SEQ ID NO: 2453 - RNA, 21 nt, Artificial Sequence
  Description of Artificial Sequence: Synthetic oligonucleotide
  modified_base (20)..(21): 2'-methoxy-nucleotide
ugcuggucugccgccguuuuu

SEQ ID NO: 2454 - RNA, 21 nt, Artificial Sequence
  Description of Artificial Sequence: Synthetic oligonucleotide
  modified_base (20)..(21): 2'-methoxy-nucleotide
augcuggucugccgccguuuu

SEQ ID NO: 2455 - RNA, 21 nt, Artificial Sequence
  Description of Artificial Sequence: Synthetic oligonucleotide
  modified_base (20)..(21): 2'-methoxy-nucleotide
caugcuggucugccgccguuu

SEQ ID NO: 2456 - RNA, 21 nt, Artificial Sequence
  Description of Artificial Sequence: Synthetic oligonucleotide
  modified_base (20)..(21): 2'-methoxy-nucleotide
ucaugcuggucugccgccguu

SEQ ID NO: 2457 - RNA, 21 nt, Artificial Sequence
  Description of Artificial Sequence: Synthetic oligonucleotide
  modified_base (20)..(21): 2'-methoxy-nucleotide
gucaugcuggucugccgccuu

SEQ ID NO: 2458 - RNA, 21 nt, Artificial Sequence
  Description of Artificial Sequence: Synthetic oligonucleotide
  modified_base (20)..(21): 2'-methoxy-nucleotide
ugucaugcuggucugccgcuu

SEQ ID NO: 2459 - RNA, 21 nt, Artificial Sequence
  Description of Artificial Sequence: Synthetic oligonucleotide
  modified_base (20)..(21): 2'-methoxy-nucleotide
cugucaugcuggucugccguu

SEQ ID NO: 2460 - RNA, 21 nt, Artificial Sequence
  Description of Artificial Sequence: Synthetic oligonucleotide
  modified_base (20)..(21): 2'-methoxy-nucleotide
ucugucaugcuggucugccuu

SEQ ID NO: 2461 - RNA, 21 nt, Artificial Sequence
  Description of Artificial Sequence: Synthetic oligonucleotide
  modified_base (20)..(21): 2'-methoxy-nucleotide
aucugucaugcuggucugcuu

SEQ ID NO: 2462 - RNA, 21 nt, Artificial Sequence
  Description of Artificial Sequence: Synthetic oligonucleotide
  modified_base (20)..(21): 2'-methoxy-nucleotide
aaucugucaugcuggucuguu

SEQ ID NO: 2463 - RNA, 21 nt, Artificial Sequence
  Description of Artificial Sequence: Synthetic oligonucleotide
  modified_base (20)..(21): 2'-methoxy-nucleotide
aaaucugucaugcuggucuuu

SEQ ID NO: 2464 - RNA, 21 nt, Artificial Sequence
  Description of Artificial Sequence: Synthetic oligonucleotide
  modified_base (20)..(21): 2'-methoxy-nucleotide
gaaaucugucaugcuggucuu

SEQ ID NO: 2465 - RNA, 21 nt, Artificial Sequence
  Description of Artificial Sequence: Synthetic oligonucleotide
  modified_base (20)..(21): 2'-methoxy-nucleotide
agaaaucugucaugcugguuu

SEQ ID NO: 2466 - RNA, 21 nt, Artificial Sequence
  Description of Artificial Sequence: Synthetic oligonucleotide
  modified_base (20)..(21): 2'-methoxy-nucleotide
uagaaaucugucaugcugguu

SEQ ID NO: 2467 - RNA, 21 nt, Artificial Sequence
  Description of Artificial Sequence: Synthetic oligonucleotide
  modified_base (20)..(21): 2'-methoxy-nucleotide
guagaaaucugucaugcuguu

SEQ ID NO: 2468 - RNA, 21 nt, Artificial Sequence
  Description of Artificial Sequence: Synthetic oligonucleotide
  modified_base (20)..(21): 2'-methoxy-nucleotide
gguagaaaucugucaugcuuu

SEQ ID NO: 2469 - RNA, 21 nt, Artificial Sequence
  Description of Artificial Sequence: Synthetic oligonucleotide
  modified_base (20)..(21): 2'-methoxy-nucleotide
ugguagaaaucugucaugcuu

SEQ ID NO: 2470 - RNA, 21 nt, Artificial Sequence
  Description of Artificial Sequence: Synthetic oligonucleotide
  modified_base (20)..(21): 2'-methoxy-nucleotide
gugguagaaaucugucauguu

SEQ ID NO: 2471 - RNA, 21 nt, Artificial Sequence
  Description of Artificial Sequence: Synthetic oligonucleotide
  modified_base (20)..(21): 2'-methoxy-nucleotide
agugguagaaaucugucauuu

SEQ ID NO: 2472 - RNA, 21 nt, Artificial Sequence
  Description of Artificial Sequence: Synthetic oligonucleotide
  modified_base (20)..(21): 2'-methoxy-nucleotide
gagugguagaaaucugucauu

SEQ ID NO: 2473 - RNA, 21 nt, Artificial Sequence
  Description of Artificial Sequence: Synthetic oligonucleotide
  modified_base (20)..(21): 2'-methoxy-nucleotide
ggagugguagaaaucugucuu

SEQ ID NO: 2474 - RNA, 21 nt, Artificial Sequence
  Description of Artificial Sequence: Synthetic oligonucleotide
  modified_base (20)..(21): 2'-methoxy-nucleotide
uggagugguagaaaucuguuu

SEQ ID NO: 2475 - RNA, 21 nt, Artificial Sequence
  Description of Artificial Sequence: Synthetic oligonucleotide
  modified_base (20)..(21): 2'-methoxy-nucleotide
uuggagugguagaaaucuguu

SEQ ID NO: 2476 - RNA, 21 nt, Artificial Sequence
  Description of Artificial Sequence: Synthetic oligonucleotide
  modified_base (20)..(21): 2'-methoxy-nucleotide
uuuggagugguagaaaucuuu

SEQ ID NO: 2477 - RNA, 21 nt, Artificial Sequence
  Description of Artificial Sequence: Synthetic oligonucleotide
  modified_base (20)..(21): 2'-methoxy-nucleotide
guuuggagugguagaaaucuu

SEQ ID NO: 2478 - RNA, 21 nt, Artificial Sequence
  Description of Artificial Sequence: Synthetic oligonucleotide
  modified_base (20)..(21): 2'-methoxy-nucleotide
cguuuggagugguagaaauuu

SEQ ID NO: 2479 - RNA, 21 nt, Artificial Sequence
  Description of Artificial Sequence: Synthetic oligonucleotide
  modified_base (20)..(21): 2'-methoxy-nucleotide
gcguuuggagugguagaaauu

SEQ ID NO: 2480 - RNA, 21 nt, Artificial Sequence
  Description of Artificial Sequence: Synthetic oligonucleotide
  modified_base (20)..(21): 2'-methoxy-nucleotide
ggcguuuggagugguagaauu

SEQ ID NO: 2481 - RNA, 21 nt, Artificial Sequence
  Description of Artificial Sequence: Synthetic oligonucleotide
  modified_base (20)..(21): 2'-methoxy-nucleotide
cggcguuuggagugguagauu

SEQ ID NO: 2482 - RNA, 21 nt, Artificial Sequence
  Description of Artificial Sequence: Synthetic oligonucleotide
  modified_base (20)..(21): 2'-methoxy-nucleotide
ccggcguuuggagugguaguu

SEQ ID NO: 2483 - RNA, 21 nt, Artificial Sequence
  Description of Artificial Sequence: Synthetic oligonucleotide
  modified_base (20)..(21): 2'-methoxy-nucleotide
gccggcguuuggagugguauu

SEQ ID NO: 2484 - RNA, 21 nt, Artificial Sequence
  Description of Artificial Sequence: Synthetic oligonucleotide
  modified_base (20)..(21): 2'-methoxy-nucleotide
agccggcguuuggagugguuu

SEQ ID NO: 2485 - RNA, 21 nt, Artificial Sequence
  Description of Artificial Sequence: Synthetic oligonucleotide
  modified_base (20)..(21): 2'-methoxy-nucleotide
cagccggcguuuggagugguu

SEQ ID NO: 2486 - RNA, 21 nt, Artificial Sequence
  Description of Artificial Sequence: Synthetic oligonucleotide
  modified_base (20)..(21): 2'-methoxy-nucleotide
ucagccggcguuuggaguguu

SEQ ID NO: 2487 - RNA, 21 nt, Artificial Sequence
  Description of Artificial Sequence: Synthetic oligonucleotide
  modified_base (20)..(21): 2'-methoxy-nucleotide
aucagccggcguuuggaguuu

SEQ ID NO: 2488 - RNA, 21 nt, Artificial Sequence
  Description of Artificial Sequence: Synthetic oligonucleotide
  modified_base (20)..(21): 2'-methoxy-nucleotide
gaucagccggcguuuggaguu

SEQ ID NO: 2489 - RNA, 21 nt, Artificial Sequence
  Description of Artificial Sequence: Synthetic oligonucleotide
  modified_base (20)..(21): 2'-methoxy-nucleotide
agaucagccggcguuuggauu

SEQ ID NO: 2490 - RNA, 21 nt, Artificial Sequence
  Description of Artificial Sequence: Synthetic oligonucleotide
  modified_base (20)..(21): 2'-methoxy-nucleotide
aagaucagccggcguuugguu

SEQ ID NO: 2491 - RNA, 21 nt, Artificial Sequence
  Description of Artificial Sequence: Synthetic oligonucleotide
  modified_base (20)..(21): 2'-methoxy-nucleotide
gaagaucagccggcguuuguu

SEQ ID NO: 2492 - RNA, 21 nt, Artificial Sequence
  Description of Artificial Sequence: Synthetic oligonucleotide
  modified_base (20)..(21): 2'-methoxy-nucleotide
agaagaucagccggcguuuuu

SEQ ID NO: 2493 - RNA, 21 nt, Artificial Sequence
  Description of Artificial Sequence: Synthetic oligonucleotide
  modified_base (20)..(21): 2'-methoxy-nucleotide
gagaagaucagccggcguuuu

SEQ ID NO: 2494 - RNA, 21 nt, Artificial Sequence
  Description of Artificial Sequence: Synthetic oligonucleotide
  modified_base (20)..(21): 2'-methoxy-nucleotide
ggagaagaucagccggcguuu

SEQ ID NO: 2495 - RNA, 21 nt, Artificial Sequence
  Description of Artificial Sequence: Synthetic oligonucleotide
  modified_base (20)..(21): 2'-methoxy-nucleotide
uggagaagaucagccggcguu

SEQ ID NO: 2496 - RNA, 21 nt, Artificial Sequence
  Description of Artificial Sequence: Synthetic oligonucleotide
  modified_base (20)..(21): 2'-methoxy-nucleotide
uuggagaagaucagccggcuu

SEQ ID NO: 2497 - RNA, 21 nt, Artificial Sequence
  Description of Artificial Sequence: Synthetic oligonucleotide
  modified_base (20)..(21): 2'-methoxy-nucleotide
cuuggagaagaucagccgguu

SEQ ID NO: 2498 - RNA, 21 nt, Artificial Sequence
  Description of Artificial Sequence: Synthetic oligonucleotide
  modified_base (20)..(21): 2'-methoxy-nucleotide
ucuuggagaagaucagccguu

SEQ ID NO: 2499 - RNA, 21 nt, Artificial Sequence
  Description of Artificial Sequence: Synthetic oligonucleotide
  modified_base (20)..(21): 2'-methoxy-nucleotide
cucuuggagaagaucagccuu

SEQ ID NO: 2500 - RNA, 21 nt, Artificial Sequence
  Description of Artificial Sequence: Synthetic oligonucleotide
  modified_base (20)..(21): 2'-methoxy-nucleotide
ccucuuggagaagaucagcuu

SEQ ID NO: 2501 - RNA, 21 nt, Artificial Sequence
  Description of Artificial Sequence: Synthetic oligonucleotide
  modified_base (20)..(21): 2'-methoxy-nucleotide
uccucuuggagaagaucaguu

SEQ ID NO: 2502 - RNA, 21 nt, Artificial Sequence
  Description of Artificial Sequence: Synthetic oligonucleotide
  modified_base (20)..(21): 2'-methoxy-nucleotide
uuccucuuggagaagaucauu

SEQ ID NO: 2503 - RNA, 21 nt, Artificial Sequence
  Description of Artificial Sequence: Synthetic oligonucleotide
  modified_base (20)..(21): 2'-methoxy-nucleotide
cuuccucuuggagaagaucuu

SEQ ID NO: 2504 - RNA, 21 nt, Artificial Sequence
  Description of Artificial Sequence: Synthetic oligonucleotide
  modified_base (20)..(21): 2'-methoxy-nucleotide
gcuuccucuuggagaagauuu

SEQ ID NO: 2505 - RNA, 21 nt, Artificial Sequence
  Description of Artificial Sequence: Synthetic oligonucleotide
  modified_base (20)..(21): 2'-methoxy-nucleotide
ggcuuccucuuggagaagauu

SEQ ID NO: 2506 - RNA, 21 nt, Artificial Sequence
  Description of Artificial Sequence: Synthetic oligonucleotide
  modified_base (20)..(21): 2'-methoxy-nucleotide
gggcuuccucuuggagaaguu

SEQ ID NO: 2507 - RNA, 21 nt, Artificial Sequence
  Description of Artificial Sequence: Synthetic oligonucleotide
  modified_base (20)..(21): 2'-methoxy-nucleotide
agggcuuccucuuggagaauu

SEQ ID NO: 2508 - RNA, 21 nt, Artificial Sequence
  Description of Artificial Sequence: Synthetic oligonucleotide
  modified_base (20)..(21): 2'-methoxy-nucleotide
uagggcuuccucuuggagauu

SEQ ID NO: 2509 - RNA, 21 nt, Artificial Sequence
  Description of Artificial Sequence: Synthetic oligonucleotide
  modified_base (20)..(21): 2'-methoxy-nucleotide
uuagggcuuccucuuggaguu

SEQ ID NO: 2510 - RNA, 21 nt, Artificial Sequence
  Description of Artificial Sequence: Synthetic oligonucleotide
  modified_base (20)..(21): 2'-methoxy-nucleotide
auuagggcuuccucuuggauu

SEQ ID NO: 2511 - RNA, 21 nt, Artificial Sequence
  Description of Artificial Sequence: Synthetic oligonucleotide
  modified_base (20)..(21): 2'-methoxy-nucleotide
gauuagggcuuccucuugguu

SEQ ID NO: 2512 - RNA, 21 nt, Artificial Sequence
  Description of Artificial Sequence: Synthetic oligonucleotide
  modified_base (20)..(21): 2'-methoxy-nucleotide
ggauuagggcuuccucuuguu

SEQ ID NO: 2513 - RNA, 21 nt, Artificial Sequence
  Description of Artificial Sequence: Synthetic oligonucleotide
  modified_base (20)..(21): 2'-methoxy-nucleotide
cggauuagggcuuccucuuuu

SEQ ID NO: 2514 - RNA, 21 nt, Artificial Sequence
  Description of Artificial Sequence: Synthetic oligonucleotide
  modified_base (20)..(21): 2'-methoxy-nucleotide
gcggauuagggcuuccucuuu

SEQ ID NO: 2515 - RNA, 21 nt, Artificial Sequence
  Description of Artificial Sequence: Synthetic oligonucleotide
  modified_base (20)..(21): 2'-methoxy-nucleotide
ggcggauuagggcuuccucuu

SEQ ID NO: 2516 - RNA, 21 nt, Artificial Sequence
  Description of Artificial Sequence: Synthetic oligonucleotide
  modified_base (20)..(21): 2'-methoxy-nucleotide
gggcggauuagggcuuccuuu

SEQ ID NO: 2517 - RNA, 21 nt, Artificial Sequence
  Description of Artificial Sequence: Synthetic oligonucleotide
  modified_base (20)..(21): 2'-methoxy-nucleotide
ugggcggauuagggcuuccuu

SEQ ID NO: 2518 - RNA, 21 nt, Artificial Sequence
  Description of Artificial Sequence: Synthetic oligonucleotide
  modified_base (20)..(21): 2'-methoxy-nucleotide
gugggcggauuagggcuucuu

SEQ ID NO: 2519 - RNA, 21 nt, Artificial Sequence
  Description of Artificial Sequence: Synthetic oligonucleotide
  modified_base (20)..(21): 2'-methoxy-nucleotide
ugugggcggauuagggcuuuu

SEQ ID NO: 2520 - RNA, 21 nt, Artificial Sequence
  Description of Artificial Sequence: Synthetic oligonucleotide
  modified_base (20)..(21): 2'-methoxy-nucleotide
cugugggcggauuagggcuuu

SEQ ID NO: 2521 - RNA, 21 nt, Artificial Sequence
  Description of Artificial Sequence: Synthetic oligonucleotide
  modified_base (20)..(21): 2'-methoxy-nucleotide
ccugugggcggauuagggcuu

SEQ ID NO: 2522 - RNA, 21 nt, Artificial Sequence
  Description of Artificial Sequence: Synthetic oligonucleotide
  modified_base (20)..(21): 2'-methoxy-nucleotide
uccugugggcggauuaggguu

SEQ ID NO: 2523 - RNA, 21 nt, Artificial Sequence
  Description of Artificial Sequence: Synthetic oligonucleotide
  modified_base (20)..(21): 2'-methoxy-nucleotide
uuccugugggcggauuagguu

SEQ ID NO: 2524 - RNA, 21 nt, Artificial Sequence
  Description of Artificial Sequence: Synthetic oligonucleotide
  modified_base (20)..(21): 2'-methoxy-nucleotide
cuuccugugggcggauuaguu

SEQ ID NO: 2525 - RNA, 21 nt, Artificial Sequence
  Description of Artificial Sequence: Synthetic oligonucleotide
  modified_base (20)..(21): 2'-methoxy-nucleotide
gcuuccugugggcggauuauu

SEQ ID NO: 2526 - RNA, 21 nt, Artificial Sequence
  Description of Artificial Sequence: Synthetic oligonucleotide
  modified_base (20)..(21): 2'-methoxy-nucleotide
ggcuuccugugggcggauuuu

SEQ ID NO: 2527 - RNA, 21 nt, Artificial Sequence
  Description of Artificial Sequence: Synthetic oligonucleotide
  modified_base (20)..(21): 2'-methoxy-nucleotide
aggcuuccugugggcggauuu

SEQ ID NO: 2528 - RNA, 21 nt, Artificial Sequence
  Description of Artificial Sequence: Synthetic oligonucleotide
  modified_base (20)..(21): 2'-methoxy-nucleotide
caggcuuccugugggcggauu

SEQ ID NO: 2529 - RNA, 21 nt, Artificial Sequence
  Description of Artificial Sequence: Synthetic oligonucleotide
  modified_base (20)..(21): 2'-methoxy-nucleotide
gcaggcuuccugugggcgguu

SEQ ID NO: 2530 - RNA, 21 nt, Artificial Sequence
  Description of Artificial Sequence: Synthetic oligonucleotide
  modified_base (20)..(21): 2'-methoxy-nucleotide
ugcaggcuuccugugggcguu

SEQ ID NO: 2531 - RNA, 21 nt, Artificial Sequence
  Description of Artificial Sequence: Synthetic oligonucleotide
  modified_base (20)..(21): 2'-methoxy-nucleotide
cugcaggcuuccugugggcuu

SEQ ID NO: 2532 - RNA, 21 nt, Artificial Sequence
  Description of Artificial Sequence: Synthetic oligonucleotide
  modified_base (20)..(21): 2'-methoxy-nucleotide
acugcaggcuuccuguggguu

SEQ ID NO: 2533 - RNA, 21 nt, Artificial Sequence
  Description of Artificial Sequence: Synthetic oligonucleotide
  modified_base (20)..(21): 2'-methoxy-nucleotide
gacugcaggcuuccugugguu

SEQ ID NO: 2534 - RNA, 21 nt, Artificial Sequence
  Description of Artificial Sequence: Synthetic oligonucleotide
  modified_base (20)..(21): 2'-methoxy-nucleotide
ggacugcaggcuuccuguguu

SEQ ID NO: 2535 - RNA, 21 nt, Artificial Sequence
  Description of Artificial Sequence: Synthetic oligonucleotide
  modified_base (20)..(21): 2'-methoxy-nucleotide
aggacugcaggcuuccuguuu

SEQ ID NO: 2536 - RNA, 21 nt, Artificial Sequence
  Description of Artificial Sequence: Synthetic oligonucleotide
  modified_base (20)..(21): 2'-methoxy-nucleotide
caggacugcaggcuuccuguu

SEQ ID NO: 2537 - RNA, 21 nt, Artificial Sequence
  Description of Artificial Sequence: Synthetic oligonucleotide
  modified_base (20)..(21): 2'-methoxy-nucleotide
ccaggacugcaggcuuccuuu

SEQ ID NO: 2538 - RNA, 21 nt, Artificial Sequence
  Description of Artificial Sequence: Synthetic oligonucleotide
  modified_base (20)..(21): 2'-methoxy-nucleotide
uccaggacugcaggcuuccuu

SEQ ID NO: 2539 - RNA, 21 nt, Artificial Sequence
  Description of Artificial Sequence: Synthetic oligonucleotide
  modified_base (20)..(21): 2'-methoxy-nucleotide
uuccaggacugcaggcuucuu

SEQ ID NO: 2540 - RNA, 21 nt, Artificial Sequence
  Description of Artificial Sequence: Synthetic oligonucleotide
  modified_base (20)..(21): 2'-methoxy-nucleotide
cuuccaggacugcaggcuuuu

SEQ ID NO: 2541 - RNA, 21 nt, Artificial Sequence
  Description of Artificial Sequence: Synthetic oligonucleotide
  modified_base (20)..(21): 2'-methoxy-nucleotide
gcuuccaggacugcaggcuuu

SEQ ID NO: 2542 - RNA, 21 nt, Artificial Sequence
  Description of Artificial Sequence: Synthetic oligonucleotide
  modified_base (20)..(21): 2'-methoxy-nucleotide
cgcuuccaggacugcaggcuu

SEQ ID NO: 2543 - RNA, 21 nt, Artificial Sequence
  Description of Artificial Sequence: Synthetic oligonucleotide
  modified_base (20)..(21): 2'-methoxy-nucleotide
gcgcuuccaggacugcagguu

SEQ ID NO: 2544 - RNA, 21 nt, Artificial Sequence
  Description of Artificial Sequence: Synthetic oligonucleotide
  modified_base (20)..(21): 2'-methoxy-nucleotide
cgcgcuuccaggacugcaguu

SEQ ID NO: 2545 - RNA, 21 nt, Artificial Sequence
  Description of Artificial Sequence: Synthetic oligonucleotide
  modified_base (20)..(21): 2'-methoxy-nucleotide
ucgcgcuuccaggacugcauu

SEQ ID NO: 2546 - RNA, 21 nt, Artificial Sequence
  Description of Artificial Sequence: Synthetic oligonucleotide
  modified_base (20)..(21): 2'-methoxy-nucleotide
cucgcgcuuccaggacugcuu

SEQ ID NO: 2547 - RNA, 21 nt, Artificial Sequence
  Description of Artificial Sequence: Synthetic oligonucleotide
  modified_base (20)..(21): 2'-methoxy-nucleotide
ccucgcgcuuccaggacuguu

SEQ ID NO: 2548 - RNA, 21 nt, Artificial Sequence
  Description of Artificial Sequence: Synthetic oligonucleotide
  modified_base (20)..(21): 2'-methoxy-nucleotide
cccucgcgcuuccaggacuuu

SEQ ID NO: 2549 - RNA, 21 nt, Artificial Sequence
  Description of Artificial Sequence: Synthetic oligonucleotide
  modified_base (20)..(21): 2'-methoxy-nucleotide
gcccucgcgcuuccaggacuu

SEQ ID NO: 2550 - RNA, 21 nt, Artificial Sequence
  Description of Artificial Sequence: Synthetic oligonucleotide
  modified_base (20)..(21): 2'-methoxy-nucleotide
ggcccucgcgcuuccaggauu

SEQ ID NO: 2551 - RNA, 21 nt, Artificial Sequence
  Description of Artificial Sequence: Synthetic oligonucleotide
  modified_base (20)..(21): 2'-methoxy-nucleotide
aggcccucgcgcuuccagguu

SEQ ID NO: 2552 - RNA, 21 nt, Artificial Sequence
  Description of Artificial Sequence: Synthetic oligonucleotide
  modified_base (20)..(21): 2'-methoxy-nucleotide
gaggcccucgcgcuuccaguu

SEQ ID NO: 2553 - RNA, 21 nt, Artificial Sequence
  Description of Artificial Sequence: Synthetic oligonucleotide
  modified_base (20)..(21): 2'-methoxy-nucleotide
ugaggcccucgcgcuuccauu

SEQ ID NO: 2554 - RNA, 21 nt, Artificial Sequence
  Description of Artificial Sequence: Synthetic oligonucleotide
  modified_base (20)..(21): 2'-methoxy-nucleotide
uugaggcccucgcgcuuccuu

SEQ ID NO: 2555 - RNA, 21 nt, Artificial Sequence
  Description of Artificial Sequence: Synthetic oligonucleotide
  modified_base (20)..(21): 2'-methoxy-nucleotide
uuugaggcccucgcgcuucuu

SEQ ID NO: 2556 - RNA, 21 nt, Artificial Sequence
  Description of Artificial Sequence: Synthetic oligonucleotide
  modified_base (20)..(21): 2'-methoxy-nucleotide
cuuugaggcccucgcgcuuuu

SEQ ID NO: 2557 - RNA, 21 nt, Artificial Sequence
  Description of Artificial Sequence: Synthetic oligonucleotide
  modified_base (20)..(21): 2'-methoxy-nucleotide
ccuuugaggcccucgcgcuuu

SEQ ID NO: 2558 - RNA, 21 nt, Artificial Sequence
  Description of Artificial Sequence: Synthetic oligonucleotide
  modified_base (20)..(21): 2'-methoxy-nucleotide
gccuuugaggcccucgcgcuu

SEQ ID NO: 2559 - RNA, 21 nt, Artificial Sequence
  Description of Artificial Sequence: Synthetic oligonucleotide
  modified_base (20)..(21): 2'-methoxy-nucleotide
ggccuuugaggcccucgcguu

SEQ ID NO: 2560 - RNA, 21 nt, Artificial Sequence
  Description of Artificial Sequence: Synthetic oligonucleotide
  modified_base (20)..(21): 2'-methoxy-nucleotide
gggccuuugaggcccucgcuu

SEQ ID NO: 2561 - RNA, 21 nt, Artificial Sequence
  Description of Artificial Sequence: Synthetic oligonucleotide
  modified_base (20)..(21): 2'-methoxy-nucleotide
cgggccuuugaggcccucguu

SEQ ID NO: 2562 - RNA, 21 nt, Artificial Sequence
  Description of Artificial Sequence: Synthetic oligonucleotide
  modified_base (20)..(21): 2'-methoxy-nucleotide
gcgggccuuugaggcccucuu

SEQ ID NO: 2563 - RNA, 21 nt, Artificial Sequence
  Description of Artificial Sequence: Synthetic oligonucleotide
  modified_base (20)..(21): 2'-methoxy-nucleotide
agcgggccuuugaggcccuuu

SEQ ID NO: 2564 - RNA, 21 nt, Artificial Sequence
  Description of Artificial Sequence: Synthetic oligonucleotide
  modified_base (20)..(21): 2'-methoxy-nucleotide
gagcgggccuuugaggcccuu

SEQ ID NO: 2565 - RNA, 21 nt, Artificial Sequence
  Description of Artificial Sequence: Synthetic oligonucleotide
  modified_base (20)..(21): 2'-methoxy-nucleotide
agagcgggccuuugaggccuu

SEQ ID NO: 2566 - RNA, 21 nt, Artificial Sequence
  Description of Artificial Sequence: Synthetic oligonucleotide
  modified_base (20)..(21): 2'-methoxy-nucleotide
uagagcgggccuuugaggcuu

SEQ ID NO: 2567 - RNA, 21 nt, Artificial Sequence
  Description of Artificial Sequence: Synthetic oligonucleotide
  modified_base (20)..(21): 2'-methoxy-nucleotide
guagagcgggccuuugagguu

SEQ ID NO: 2568 - RNA, 21 nt, Artificial Sequence
  Description of Artificial Sequence: Synthetic oligonucleotide
  modified_base (20)..(21): 2'-methoxy-nucleotide
uguagagcgggccuuugaguu

SEQ ID NO: 2569 - RNA, 21 nt, Artificial Sequence
  Description of Artificial Sequence: Synthetic oligonucleotide
  modified_base (20)..(21): 2'-methoxy-nucleotide
auguagagcgggccuuugauu

SEQ ID NO: 2570 - RNA, 21 nt, Artificial Sequence
  Description of Artificial Sequence: Synthetic oligonucleotide
  modified_base (20)..(21): 2'-methoxy-nucleotide
gauguagagcgggccuuuguu

SEQ ID NO: 2571 - RNA, 21 nt, Artificial Sequence
  Description of Artificial Sequence: Synthetic oligonucleotide
  modified_base (20)..(21): 2'-methoxy-nucleotide
agauguagagcgggccuuuuu

SEQ ID NO: 2572 - RNA, 21 nt, Artificial Sequence
  Description of Artificial Sequence: Synthetic oligonucleotide
  modified_base (20)..(21): 2'-methoxy-nucleotide
aagauguagagcgggccuuuu

SEQ ID NO: 2573 - RNA, 21 nt, Artificial Sequence
  Description of Artificial Sequence: Synthetic oligonucleotide
  modified_base (20)..(21): 2'-methoxy-nucleotide
gaagauguagagcgggccuuu

SEQ ID NO: 2574 - RNA, 21 nt, Artificial Sequence
  Description of Artificial Sequence: Synthetic oligonucleotide
  modified_base (20)..(21): 2'-methoxy-nucleotide
agaagauguagagcgggccuu

SEQ ID NO: 2575 - RNA, 21 nt, Artificial Sequence
  Description of Artificial Sequence: Synthetic oligonucleotide
  modified_base (20)..(21): 2'-methoxy-nucleotide
cagaagauguagagcgggcuu

SEQ ID NO: 2576 - RNA, 21 nt, Artificial Sequence
  Description of Artificial Sequence: Synthetic oligonucleotide
  modified_base (20)..(21): 2'-methoxy-nucleotide
gcagaagauguagagcggguu

SEQ ID NO: 2577 - RNA, 21 nt, Artificial Sequence
  Description of Artificial Sequence: Synthetic oligonucleotide
  modified_base (20)..(21): 2'-methoxy-nucleotide
ggcagaagauguagagcgguu

SEQ ID NO: 2578 - RNA, 21 nt, Artificial Sequence
  Description of Artificial Sequence: Synthetic oligonucleotide
  modified_base (20)..(21): 2'-methoxy-nucleotide
aggcagaagauguagagcguu

SEQ ID NO: 2579 - RNA, 21 nt, Artificial Sequence
  Description of Artificial Sequence: Synthetic oligonucleotide
  modified_base (20)..(21): 2'-methoxy-nucleotide
aaggcagaagauguagagcuu

SEQ ID NO: 2580 - RNA, 21 nt, Artificial Sequence
  Description of Artificial Sequence: Synthetic oligonucleotide
  modified_base (20)..(21): 2'-methoxy-nucleotide
uaaggcagaagauguagaguu

SEQ ID NO: 2581 - RNA, 21 nt, Artificial Sequence
  Description of Artificial Sequence: Synthetic oligonucleotide
  modified_base (20)..(21): 2'-methoxy-nucleotide
cuaaggcagaagauguagauu

SEQ ID NO: 2582 - RNA, 21 nt, Artificial Sequence
  Description of Artificial Sequence: Synthetic oligonucleotide
  modified_base (20)..(21): 2'-methoxy-nucleotide
acuaaggcagaagauguaguu

SEQ ID NO: 2583 - RNA, 21 nt, Artificial Sequence
  Description of Artificial Sequence: Synthetic oligonucleotide
  modified_base (20)..(21): 2'-methoxy-nucleotide
gacuaaggcagaagauguauu

SEQ ID NO: 2584 - RNA, 21 nt, Artificial Sequence
  Description of Artificial Sequence: Synthetic oligonucleotide
  modified_base (20)..(21): 2'-methoxy-nucleotide
agacuaaggcagaagauguuu

SEQ ID NO: 2585 - RNA, 21 nt, Artificial Sequence
  Description of Artificial Sequence: Synthetic oligonucleotide
  modified_base (20)..(21): 2'-methoxy-nucleotide
gagacuaaggcagaagauguu

SEQ ID NO: 2586 - RNA, 21 nt, Artificial Sequence
  Description of Artificial Sequence: Synthetic oligonucleotide
  modified_base (20)..(21): 2'-methoxy-nucleotide
ugagacuaaggcagaagauuu

SEQ ID NO: 2587 - RNA, 21 nt, Artificial Sequence
  Description of Artificial Sequence: Synthetic oligonucleotide
  modified_base (20)..(21): 2'-methoxy-nucleotide
cugagacuaaggcagaagauu

SEQ ID NO: 2588 - RNA, 21 nt, Artificial Sequence
  Description of Artificial Sequence: Synthetic oligonucleotide
  modified_base (20)..(21): 2'-methoxy-nucleotide
acugagacuaaggcagaaguu

SEQ ID NO: 2589 - RNA, 21 nt, Artificial Sequence
  Description of Artificial Sequence: Synthetic oligonucleotide
  modified_base (20)..(21): 2'-methoxy-nucleotide
aacugagacuaaggcagaauu

SEQ ID NO: 2590 - RNA, 21 nt, Artificial Sequence
  Description of Artificial Sequence: Synthetic oligonucleotide
  modified_base (20)..(21): 2'-methoxy-nucleotide
aaacugagacuaaggcagauu

SEQ ID NO: 2591 - RNA, 21 nt, Artificial Sequence
  Description of Artificial Sequence: Synthetic oligonucleotide
  modified_base (20)..(21): 2'-methoxy-nucleotide
caaacugagacuaaggcaguu

SEQ ID NO: 2592 - RNA, 21 nt, Artificial Sequence
  Description of Artificial Sequence: Synthetic oligonucleotide
  modified_base (20)..(21): 2'-methoxy-nucleotide
acaaacugagacuaaggcauu

SEQ ID NO: 2593 - RNA, 21 nt, Artificial Sequence
  Description of Artificial Sequence: Synthetic oligonucleotide
  modified_base (20)..(21): 2'-methoxy-nucleotide
cacaaacugagacuaaggcuu

SEQ ID NO: 2594 - RNA, 21 nt, Artificial Sequence
  Description of Artificial Sequence: Synthetic oligonucleotide
  modified_base (20)..(21): 2'-methoxy-nucleotide
acacaaacugagacuaagguu

SEQ ID NO: 2595 - RNA, 21 nt, Artificial Sequence
  Description of Artificial Sequence: Synthetic oligonucleotide
  modified_base (20)..(21): 2'-methoxy-nucleotide
cacacaaacugagacuaaguu

SEQ ID NO: 2596 - RNA, 21 nt, Artificial Sequence
  Description of Artificial Sequence: Synthetic oligonucleotide
  modified_base (20)..(21): 2'-methoxy-nucleotide
acacacaaacugagacuaauu

SEQ ID NO: 2597 - RNA, 21 nt, Artificial Sequence
  Description of Artificial Sequence: Synthetic oligonucleotide
  modified_base (20)..(21): 2'-methoxy-nucleotide
gacacacaaacugagacuauu

SEQ ID NO: 2598 - RNA, 21 nt, Artificial Sequence
  Description of Artificial Sequence: Synthetic oligonucleotide
  modified_base (20)..(21): 2'-methoxy-nucleotide
agacacacaaacugagacuuu

SEQ ID NO: 2599 - RNA, 21 nt, Artificial Sequence
  Description of Artificial Sequence: Synthetic oligonucleotide
  modified_base (20)..(21): 2'-methoxy-nucleotide
aagacacacaaacugagacuu

SEQ ID NO: 2600 - RNA, 21 nt, Artificial Sequence
  Description of Artificial Sequence: Synthetic oligonucleotide
  modified_base (20)..(21): 2'-methoxy-nucleotide
uaagacacacaaacugagauu

SEQ ID NO: 2601 - RNA, 21 nt, Artificial Sequence
  Description of Artificial Sequence: Synthetic oligonucleotide
  modified_base (20)..(21): 2'-methoxy-nucleotide
uuaagacacacaaacugaguu

SEQ ID NO: 2602 - RNA, 21 nt, Artificial Sequence
  Description of Artificial Sequence: Synthetic oligonucleotide
  modified_base (20)..(21): 2'-methoxy-nucleotide
auuaagacacacaaacugauu

SEQ ID NO: 2603 - RNA, 21 nt, Artificial Sequence
  Description of Artificial Sequence: Synthetic oligonucleotide
  modified_base (20)..(21): 2'-methoxy-nucleotide
aauuaagacacacaaacuguu

SEQ ID NO: 2604 - RNA, 21 nt, Artificial Sequence
  Description of Artificial Sequence: Synthetic oligonucleotide
  modified_base (20)..(21): 2'-methoxy-nucleotide
uaauuaagacacacaaacuuu

SEQ ID NO: 2605 - RNA, 21 nt, Artificial Sequence
  Description of Artificial Sequence: Synthetic oligonucleotide
  modified_base (20)..(21): 2'-methoxy-nucleotide
auaauuaagacacacaaacuu

SEQ ID NO: 2606 - RNA, 21 nt, Artificial Sequence
  Description of Artificial Sequence: Synthetic oligonucleotide
  modified_base (20)..(21): 2'-methoxy-nucleotide
aauaauuaagacacacaaauu

SEQ ID NO: 2607 - RNA, 21 nt, Artificial Sequence
  Description of Artificial Sequence: Synthetic oligonucleotide
  modified_base (20)..(21): 2'-methoxy-nucleotide
uaauaauuaagacacacaauu

SEQ ID NO: 2608 - RNA, 21 nt, Artificial Sequence
  Description of Artificial Sequence: Synthetic oligonucleotide
  modified_base (20)..(21): 2'-methoxy-nucleotide
auaauaauuaagacacacauu

SEQ ID NO: 2609 - RNA, 21 nt, Artificial Sequence
  Description of Artificial Sequence: Synthetic oligonucleotide
  modified_base (20)..(21): 2'-methoxy-nucleotide
aauaauaauuaagacacacuu

SEQ ID NO: 2610 - RNA, 21 nt, Artificial Sequence
  Description of Artificial Sequence: Synthetic oligonucleotide
  modified_base (20)..(21): 2'-methoxy-nucleotide
aaauaauaauuaagacacauu

SEQ ID NO: 2611 - RNA, 21 nt, Artificial Sequence
  Description of Artificial Sequence: Synthetic oligonucleotide
  modified_base (20)..(21): 2'-methoxy-nucleotide
caaauaauaauuaagacacuu

SEQ ID NO: 2612 - RNA, 21 nt, Artificial Sequence
  Description of Artificial Sequence: Synthetic oligonucleotide
  modified_base (20)..(21): 2'-methoxy-nucleotide
acaaauaauaauuaagacauu

SEQ ID NO: 2613 - RNA, 21 nt, Artificial Sequence
  Description of Artificial Sequence: Synthetic oligonucleotide
  modified_base (20)..(21): 2'-methoxy-nucleotide
cacaaauaauaauuaagacuu

SEQ ID NO: 2614 - RNA, 21 nt, Artificial Sequence
  Description of Artificial Sequence: Synthetic oligonucleotide
  modified_base (20)..(21): 2'-methoxy-nucleotide
acacaaauaauaauuaagauu

SEQ ID NO: 2615 - RNA, 21 nt, Artificial Sequence
  Description of Artificial Sequence: Synthetic oligonucleotide
  modified_base (20)..(21): 2'-methoxy-nucleotide
aacacaaauaauaauuaaguu

SEQ ID NO: 2616 - RNA, 21 nt, Artificial Sequence
  Description of Artificial Sequence: Synthetic oligonucleotide
  modified_base (20)..(21): 2'-methoxy-nucleotide
aaacacaaauaauaauuaauu

SEQ ID NO: 2617 - RNA, 21 nt, Artificial Sequence
  Description of Artificial Sequence: Synthetic oligonucleotide
  modified_base (20)..(21): 2'-methoxy-nucleotide
aaaacacaaauaauaauuauu

SEQ ID NO: 2618 - RNA, 21 nt, Artificial Sequence
  Description of Artificial Sequence: Synthetic oligonucleotide
  modified_base (20)..(21): 2'-methoxy-nucleotide
uaaaacacaaauaauaauuuu

SEQ ID NO: 2619 - RNA, 21 nt, Artificial Sequence
  Description of Artificial Sequence: Synthetic oligonucleotide
  modified_base (20)..(21): 2'-methoxy-nucleotide
uuaaaacacaaauaauaauuu

SEQ ID NO: 2620 - RNA, 21 nt, Artificial Sequence
  Description of Artificial Sequence: Synthetic oligonucleotide
  modified_base (20)..(21): 2'-methoxy-nucleotide
auuaaaacacaaauaauaauu

SEQ ID NO: 2621 - RNA, 21 nt, Artificial Sequence
  Description of Artificial Sequence: Synthetic oligonucleotide
  modified_base (20)..(21): 2'-methoxy-nucleotide
aauuaaaacacaaauaauauu

SEQ ID NO: 2622 - RNA, 21 nt, Artificial Sequence
  Description of Artificial Sequence: Synthetic oligonucleotide
  modified_base (20)..(21): 2'-methoxy-nucleotide
aaauuaaaacacaaauaauuu

SEQ ID NO: 2623 - RNA, 21 nt, Artificial Sequence
  Description of Artificial Sequence: Synthetic oligonucleotide
  modified_base (20)..(21): 2'-methoxy-nucleotide
uaaauuaaaacacaaauaauu

SEQ ID NO: 2624 - RNA, 21 nt, Artificial Sequence
  Description of Artificial Sequence: Synthetic oligonucleotide
  modified_base (20)..(21): 2'-methoxy-nucleotide
uuaaauuaaaacacaaauauu

SEQ ID NO: 2625 - RNA, 21 nt, Artificial Sequence
  Description of Artificial Sequence: Synthetic oligonucleotide
  modified_base (20)..(21): 2'-methoxy-nucleotide
uuuaaauuaaaacacaaauuu

SEQ ID NO: 2626 - RNA, 21 nt, Artificial Sequence
  Description of Artificial Sequence: Synthetic oligonucleotide
  modified_base (20)..(21): 2'-methoxy-nucleotide
guuuaaauuaaaacacaaauu

SEQ ID NO: 2627 - RNA, 21 nt, Artificial Sequence
  Description of Artificial Sequence: Synthetic oligonucleotide
  modified_base (20)..(21): 2'-methoxy-nucleotide
uguuuaaauuaaaacacaauu

SEQ ID NO: 2628 - RNA, 21 nt, Artificial Sequence
  Description of Artificial Sequence: Synthetic oligonucleotide
  modified_base (20)..(21): 2'-methoxy-nucleotide
guguuuaaauuaaaacacauu

SEQ ID NO: 2629 - RNA, 21 nt, Artificial Sequence
  Description of Artificial Sequence: Synthetic oligonucleotide
  modified_base (20)..(21): 2'-methoxy-nucleotide
gguguuuaaauuaaaacacuu

SEQ ID NO: 2630 - RNA, 21 nt, Artificial Sequence
  Description of Artificial Sequence: Synthetic oligonucleotide
  modified_base (20)..(21): 2'-methoxy-nucleotide
agguguuuaaauuaaaacauu

SEQ ID NO: 2631 - RNA, 21 nt, Artificial Sequence
  Description of Artificial Sequence: Synthetic oligonucleotide
  modified_base (20)..(21): 2'-methoxy-nucleotide
gagguguuuaaauuaaaacuu

SEQ ID NO: 2632 - RNA, 21 nt, Artificial Sequence
  Description of Artificial Sequence: Synthetic oligonucleotide
  modified_base (20)..(21): 2'-methoxy-nucleotide
ggagguguuuaaauuaaaauu

SEQ ID NO: 2633 - RNA, 21 nt, Artificial Sequence
  Description of Artificial Sequence: Synthetic oligonucleotide
  modified_base (20)..(21): 2'-methoxy-nucleotide
aggagguguuuaaauuaaauu

SEQ ID NO: 2634 - RNA, 21 nt, Artificial Sequence
  Description of Artificial Sequence: Synthetic oligonucleotide
  modified_base (20)..(21): 2'-methoxy-nucleotide
gaggagguguuuaaauuaauu

SEQ ID NO: 2635 - RNA, 21 nt, Artificial Sequence
  Description of Artificial Sequence: Synthetic oligonucleotide
  modified_base (20)..(21): 2'-methoxy-nucleotide
ugaggagguguuuaaauuauu

SEQ ID NO: 2636 - RNA, 21 nt, Artificial Sequence
  Description of Artificial Sequence: Synthetic oligonucleotide
  modified_base (20)..(21): 2'-methoxy-nucleotide
augaggagguguuuaaauuuu

SEQ ID NO: 2637 - RNA, 21 nt, Artificial Sequence
  Description of Artificial Sequence: Synthetic oligonucleotide
  modified_base (20)..(21): 2'-methoxy-nucleotide
caugaggagguguuuaaauuu

SEQ ID NO: 2638 - RNA, 21 nt, Artificial Sequence
  Description of Artificial Sequence: Synthetic oligonucleotide
  modified_base (20)..(21): 2'-methoxy-nucleotide
acaugaggagguguuuaaauu

SEQ ID NO: 2639 - RNA, 21 nt, Artificial Sequence
  Description of Artificial Sequence: Synthetic oligonucleotide
  modified_base (20)..(21): 2'-methoxy-nucleotide
uacaugaggagguguuuaauu

SEQ ID NO: 2640 - RNA, 21 nt, Artificial Sequence
  Description of Artificial Sequence: Synthetic oligonucleotide
  modified_base (20)..(21): 2'-methoxy-nucleotide
guacaugaggagguguuuauu

SEQ ID NO: 2641 - RNA, 21 nt, Artificial Sequence
  Description of Artificial Sequence: Synthetic oligonucleotide
  modified_base (20)..(21): 2'-methoxy-nucleotide
uguacaugaggagguguuuuu

SEQ ID NO: 2642 - RNA, 21 nt, Artificial Sequence
  Description of Artificial Sequence: Synthetic oligonucleotide
  modified_base (20)..(21): 2'-methoxy-nucleotide
auguacaugaggagguguuuu

SEQ ID NO: 2643 - RNA, 21 nt, Artificial Sequence
  Description of Artificial Sequence: Synthetic oligonucleotide
  modified_base (20)..(21): 2'-methoxy-nucleotide
uauguacaugaggagguguuu

SEQ ID NO: 2644 - RNA, 21 nt, Artificial Sequence
  Description of Artificial Sequence: Synthetic oligonucleotide
  modified_base (20)..(21): 2'-methoxy-nucleotide
guauguacaugaggagguguu

SEQ ID NO: 2645 - RNA, 21 nt, Artificial Sequence
  Description of Artificial Sequence: Synthetic oligonucleotide
  modified_base (20)..(21): 2'-methoxy-nucleotide
gguauguacaugaggagguuu

SEQ ID NO: 2646 - RNA, 21 nt, Artificial Sequence
  Description of Artificial Sequence: Synthetic oligonucleotide
  modified_base (20)..(21): 2'-methoxy-nucleotide
ggguauguacaugaggagguu

SEQ ID NO: 2647 - RNA, 21 nt, Artificial Sequence
  Description of Artificial Sequence: Synthetic oligonucleotide
  modified_base (20)..(21): 2'-methoxy-nucleotide
aggguauguacaugaggaguu

SEQ ID NO: 2648 - RNA, 21 nt, Artificial Sequence
  Description of Artificial Sequence: Synthetic oligonucleotide
  modified_base (20)..(21): 2'-methoxy-nucleotide
caggguauguacaugaggauu

SEQ ID NO: 2649 - RNA, 21 nt, Artificial Sequence
  Description of Artificial Sequence: Synthetic oligonucleotide
  modified_base (20)..(21): 2'-methoxy-nucleotide
ccaggguauguacaugagguu

SEQ ID NO: 2650 - RNA, 21 nt, Artificial Sequence
  Description of Artificial Sequence: Synthetic oligonucleotide
  modified_base (20)..(21): 2'-methoxy-nucleotide
gccaggguauguacaugaguu

SEQ ID NO: 2651 - RNA, 21 nt, Artificial Sequence
  Description of Artificial Sequence: Synthetic oligonucleotide
  modified_base (20)..(21): 2'-methoxy-nucleotide
ggccaggguauguacaugauu

SEQ ID NO: 2652 - RNA, 21 nt, Artificial Sequence
  Description of Artificial Sequence: Synthetic oligonucleotide
  modified_base (20)..(21): 2'-methoxy-nucleotide
cggccaggguauguacauguu

SEQ ID NO: 2653 - RNA, 21 nt, Artificial Sequence
  Description of Artificial Sequence: Synthetic oligonucleotide
  modified_base (20)..(21): 2'-methoxy-nucleotide
gcggccaggguauguacauuu

SEQ ID NO: 2654 - RNA, 21 nt, Artificial Sequence
  Description of Artificial Sequence: Synthetic oligonucleotide
  modified_base (20)..(21): 2'-methoxy-nucleotide
ggcggccaggguauguacauu

SEQ ID NO: 2655 - RNA, 21 nt, Artificial Sequence
  Description of Artificial Sequence: Synthetic oligonucleotide
  modified_base (20)..(21): 2'-methoxy-nucleotide
gggcggccaggguauguacuu

SEQ ID NO: 2656 - RNA, 21 nt, Artificial Sequence
  Description of Artificial Sequence: Synthetic oligonucleotide
  modified_base (20)..(21): 2'-methoxy-nucleotide
ggggcggccaggguauguauu

SEQ ID NO: 2657 - RNA, 21 nt, Artificial Sequence
  Description of Artificial Sequence: Synthetic oligonucleotide
  modified_base (20)..(21): 2'-methoxy-nucleotide
gggggcggccaggguauguuu

SEQ ID NO: 2658 - RNA, 21 nt, Artificial Sequence
  Description of Artificial Sequence: Synthetic oligonucleotide
  modified_base (20)..(21): 2'-methoxy-nucleotide
agggggcggccaggguauguu

SEQ ID NO: 2659 - RNA, 21 nt, Artificial Sequence
  Description of Artificial Sequence: Synthetic oligonucleotide
  modified_base (20)..(21): 2'-methoxy-nucleotide
cagggggcggccaggguauuu

SEQ ID NO: 2660 - RNA, 21 nt, Artificial Sequence
  Description of Artificial Sequence: Synthetic oligonucleotide
  modified_base (20)..(21): 2'-methoxy-nucleotide
gcagggggcggccaggguauu

SEQ ID NO: 2661 - RNA, 21 nt, Artificial Sequence
  Description of Artificial Sequence: Synthetic oligonucleotide
  modified_base (20)..(21): 2'-methoxy-nucleotide
ggcagggggcggccaggguuu

SEQ ID NO: 2662 - RNA, 21 nt, Artificial Sequence
  Description of Artificial Sequence: Synthetic oligonucleotide
  modified_base (20)..(21): 2'-methoxy-nucleotide
gggcagggggcggccaggguu

SEQ ID NO: 2663 - RNA, 21 nt, Artificial Sequence
  Description of Artificial Sequence: Synthetic oligonucleotide
  modified_base (20)..(21): 2'-methoxy-nucleotide
ggggcagggggcggccagguu

SEQ ID NO: 2664 - RNA, 21 nt, Artificial Sequence
  Description of Artificial Sequence: Synthetic oligonucleotide
  modified_base (20)..(21): 2'-methoxy-nucleotide
gggggcagggggcggccaguu

SEQ ID NO: 2665 - RNA, 21 nt, Artificial Sequence
  Description of Artificial Sequence: Synthetic oligonucleotide
  modified_base (20)..(21): 2'-methoxy-nucleotide
ggggggcagggggcggccauu

SEQ ID NO: 2666 - RNA, 21 nt, Artificial Sequence
  Description of Artificial Sequence: Synthetic oligonucleotide
  modified_base (20)..(21): 2'-methoxy-nucleotide
uggggggcagggggcggccuu

SEQ ID NO: 2667 - RNA, 21 nt, Artificial Sequence
  Description of Artificial Sequence: Synthetic oligonucleotide
  modified_base (20)..(21): 2'-methoxy-nucleotide
cuggggggcagggggcggcuu

SEQ ID NO: 2668 - RNA, 21 nt, Artificial Sequence
  Description of Artificial Sequence: Synthetic oligonucleotide
  modified_base (20)..(21): 2'-methoxy-nucleotide
gcuggggggcagggggcgguu

SEQ ID NO: 2669 - RNA, 21 nt, Artificial Sequence
  Description of Artificial Sequence: Synthetic oligonucleotide
  modified_base (20)..(21): 2'-methoxy-nucleotide
ggcuggggggcagggggcguu

SEQ ID NO: 2670 - RNA, 21 nt, Artificial Sequence
  Description of Artificial Sequence: Synthetic oligonucleotide
  modified_base (20)..(21): 2'-methoxy-nucleotide
aggcuggggggcagggggcuu

SEQ ID NO: 2671 - RNA, 21 nt, Artificial Sequence
  Description of Artificial Sequence: Synthetic oligonucleotide
  modified_base (20)..(21): 2'-methoxy-nucleotide
gaggcuggggggcaggggguu

SEQ ID NO: 2672 - RNA, 21 nt, Artificial Sequence
  Description of Artificial Sequence: Synthetic oligonucleotide
  modified_base (20)..(21): 2'-methoxy-nucleotide
agaggcuggggggcagggguu

SEQ ID NO: 2673 - RNA, 21 nt, Artificial Sequence
  Description of Artificial Sequence: Synthetic oligonucleotide
  modified_base (20)..(21): 2'-methoxy-nucleotide
cagaggcuggggggcaggguu

SEQ ID NO: 2674 - RNA, 21 nt, Artificial Sequence
  Description of Artificial Sequence: Synthetic oligonucleotide
  modified_base (20)..(21): 2'-methoxy-nucleotide
ccagaggcuggggggcagguu

SEQ ID NO: 2675 - RNA, 21 nt, Artificial Sequence
  Description of Artificial Sequence: Synthetic oligonucleotide
  modified_base (20)..(21): 2'-methoxy-nucleotide
gccagaggcuggggggcaguu

SEQ ID NO: 2676 - RNA, 21 nt, Artificial Sequence
  Description of Artificial Sequence: Synthetic oligonucleotide
  modified_base (20)..(21): 2'-methoxy-nucleotide
ugccagaggcuggggggcauu

SEQ ID NO: 2677 - RNA, 21 nt, Artificial Sequence
  Description of Artificial Sequence: Synthetic oligonucleotide
  modified_base (20)..(21): 2'-methoxy-nucleotide
augccagaggcuggggggcuu

SEQ ID NO: 2678 - RNA, 21 nt, Artificial Sequence
  Description of Artificial Sequence: Synthetic oligonucleotide
  modified_base (20)..(21): 2'-methoxy-nucleotide
aaugccagaggcugggggguu

SEQ ID NO: 2679 - RNA, 21 nt, Artificial Sequence
  Description of Artificial Sequence: Synthetic oligonucleotide
  modified_base (20)..(21): 2'-methoxy-nucleotide
uaaugccagaggcuggggguu

SEQ ID NO: 2680 - RNA, 21 nt, Artificial Sequence
  Description of Artificial Sequence: Synthetic oligonucleotide
  modified_base (20)..(21): 2'-methoxy-nucleotide
cuaaugccagaggcugggguu

SEQ ID NO: 2681 - RNA, 21 nt, Artificial Sequence
  Description of Artificial Sequence: Synthetic oligonucleotide
  modified_base (20)..(21): 2'-methoxy-nucleotide
ucuaaugccagaggcuggguu

SEQ ID NO: 2682 - RNA, 21 nt, Artificial Sequence
  Description of Artificial Sequence: Synthetic oligonucleotide
  modified_base (20)..(21): 2'-methoxy-nucleotide
uucuaaugccagaggcugguu

SEQ ID NO: 2683 - RNA, 21 nt, Artificial Sequence
  Description of Artificial Sequence: Synthetic oligonucleotide
  modified_base (20)..(21): 2'-methoxy-nucleotide
auucuaaugccagaggcuguu

SEQ ID NO: 2684 - RNA, 21 nt, Artificial Sequence
  Description of Artificial Sequence: Synthetic oligonucleotide
  modified_base (20)..(21): 2'-methoxy-nucleotide
aauucuaaugccagaggcuuu

SEQ ID NO: 2685 - RNA, 21 nt, Artificial Sequence
  Description of Artificial Sequence: Synthetic oligonucleotide
  modified_base (20)..(21): 2'-methoxy-nucleotide
uaauucuaaugccagaggcuu

SEQ ID NO: 2686 - RNA, 21 nt, Artificial Sequence
  Description of Artificial Sequence: Synthetic oligonucleotide
  modified_base (20)..(21): 2'-methoxy-nucleotide
auaauucuaaugccagagguu

SEQ ID NO: 2687 - RNA, 21 nt, Artificial Sequence
  Description of Artificial Sequence: Synthetic oligonucleotide
  modified_base (20)..(21): 2'-methoxy-nucleotide
aauaauucuaaugccagaguu

SEQ ID NO: 2688 - RNA, 21 nt, Artificial Sequence
  Description of Artificial Sequence: Synthetic oligonucleotide
  modified_base (20)..(21): 2'-methoxy-nucleotide
aaauaauucuaaugccagauu

SEQ ID NO: 2689 - RNA, 21 nt, Artificial Sequence
  Description of Artificial Sequence: Synthetic oligonucleotide
  modified_base (20)..(21): 2'-methoxy-nucleotide
uaaauaauucuaaugccaguu

SEQ ID NO: 2690 - RNA, 21 nt, Artificial Sequence
  Description of Artificial Sequence: Synthetic oligonucleotide
  modified_base (20)..(21): 2'-methoxy-nucleotide
uuaaauaauucuaaugccauu

SEQ ID NO: 2691 - RNA, 21 nt, Artificial Sequence
  Description of Artificial Sequence: Synthetic oligonucleotide
  modified_base (20)..(21): 2'-methoxy-nucleotide
uuuaaauaauucuaaugccuu

SEQ ID NO: 2692 - RNA, 21 nt, Artificial Sequence
  Description of Artificial Sequence: Synthetic oligonucleotide
  modified_base (20)..(21): 2'-methoxy-nucleotide
guuuaaauaauucuaaugcuu

SEQ ID NO: 2693 - RNA, 21 nt, Artificial Sequence
  Description of Artificial Sequence: Synthetic oligonucleotide
  modified_base (20)..(21): 2'-methoxy-nucleotide
uguuuaaauaauucuaauguu

SEQ ID NO: 2694 - RNA, 21 nt, Artificial Sequence
  Description of Artificial Sequence: Synthetic oligonucleotide
  modified_base (20)..(21): 2'-methoxy-nucleotide
uuguuuaaauaauucuaauuu

SEQ ID NO: 2695 - RNA, 21 nt, Artificial Sequence
  Description of Artificial Sequence: Synthetic oligonucleotide
  modified_base (20)..(21): 2'-methoxy-nucleotide
uuuguuuaaauaauucuaauu

SEQ ID NO: 2696 - RNA, 21 nt, Artificial Sequence
  Description of Artificial Sequence: Synthetic oligonucleotide
  modified_base (20)..(21): 2'-methoxy-nucleotide
uuuuguuuaaauaauucuauu

SEQ ID NO: 2697 - RNA, 21 nt, Artificial Sequence
  Description of Artificial Sequence: Synthetic oligonucleotide
  modified_base (20)..(21): 2'-methoxy-nucleotide
uuuuuguuuaaauaauucuuu

SEQ ID NO: 2698 - RNA, 21 nt, Artificial Sequence
  Description of Artificial Sequence: Synthetic oligonucleotide
  modified_base (20)..(21): 2'-methoxy-nucleotide
guuuuuguuuaaauaauucuu

SEQ ID NO: 2699 - RNA, 21 nt, Artificial Sequence
  Description of Artificial Sequence: Synthetic oligonucleotide
  modified_base (20)..(21): 2'-methoxy-nucleotide
aguuuuuguuuaaauaauuuu

SEQ ID NO: 2700 - RNA, 21 nt, Artificial Sequence
  Description of Artificial Sequence: Synthetic oligonucleotide
  modified_base (20)..(21): 2'-methoxy-nucleotide
uaguuuuuguuuaaauaauuu

SEQ ID NO: 2701 - RNA, 21 nt, Artificial Sequence
  Description of Artificial Sequence: Synthetic oligonucleotide
  modified_base (20)..(21): 2'-methoxy-nucleotide
cuaguuuuuguuuaaauaauu

SEQ ID NO: 2702 - RNA, 21 nt, Artificial Sequence
  Description of Artificial Sequence: Synthetic oligonucleotide
  modified_base (20)..(21): 2'-methoxy-nucleotide
ccuaguuuuuguuuaaauauu

SEQ ID NO: 2703 - RNA, 21 nt, Artificial Sequence
  Description of Artificial Sequence: Synthetic oligonucleotide
  modified_base (20)..(21): 2'-methoxy-nucleotide
gccuaguuuuuguuuaaauuu

SEQ ID NO: 2704 - RNA, 21 nt, Artificial Sequence
  Description of Artificial Sequence: Synthetic oligonucleotide
  modified_base (20)..(21): 2'-methoxy-nucleotide
cgccuaguuuuuguuuaaauu

SEQ ID NO: 2705 - RNA, 21 nt, Artificial Sequence
  Description of Artificial Sequence: Synthetic oligonucleotide
  modified_base (20)..(21): 2'-methoxy-nucleotide
ccgccuaguuuuuguuuaauu

SEQ ID NO: 2706 - RNA, 21 nt, Artificial Sequence
  Description of Artificial Sequence: Synthetic oligonucleotide
  modified_base (20)..(21): 2'-methoxy-nucleotide
accgccuaguuuuuguuuauu

SEQ ID NO: 2707 - RNA, 21 nt, Artificial Sequence
  Description of Artificial Sequence: Synthetic oligonucleotide
  modified_base (20)..(21): 2'-methoxy-nucleotide
aaccgccuaguuuuuguuuuu

SEQ ID NO: 2708 - RNA, 21 nt, Artificial Sequence
  Description of Artificial Sequence: Synthetic oligonucleotide
  modified_base (20)..(21): 2'-methoxy-nucleotide
caaccgccuaguuuuuguuuu

SEQ ID NO: 2709 - RNA, 21 nt, Artificial Sequence
  Description of Artificial Sequence: Synthetic oligonucleotide
  modified_base (20)..(21): 2'-methoxy-nucleotide
ucaaccgccuaguuuuuguuu

SEQ ID NO: 2710 - RNA, 21 nt, Artificial Sequence
  Description of Artificial Sequence: Synthetic oligonucleotide
  modified_base (20)..(21): 2'-methoxy-nucleotide
uucaaccgccuaguuuuuguu

SEQ ID NO: 2711 - RNA, 21 nt, Artificial Sequence
  Description of Artificial Sequence: Synthetic oligonucleotide
  modified_base (20)..(21): 2'-methoxy-nucleotide
auucaaccgccuaguuuuuuu

SEQ ID NO: 2712 - RNA, 21 nt, Artificial Sequence
  Description of Artificial Sequence: Synthetic oligonucleotide
  modified_base (20)..(21): 2'-methoxy-nucleotide
cauucaaccgccuaguuuuuu

SEQ ID NO: 2713 - RNA, 21 nt, Artificial Sequence
  Description of Artificial Sequence: Synthetic oligonucleotide
  modified_base (20)..(21): 2'-methoxy-nucleotide
ucauucaaccgccuaguuuuu

SEQ ID NO: 2714 - RNA, 21 nt, Artificial Sequence
  Description of Artificial Sequence: Synthetic oligonucleotide
  modified_base (20)..(21): 2'-methoxy-nucleotide
cucauucaaccgccuaguuuu

SEQ ID NO: 2715 - RNA, 21 nt, Artificial Sequence
  Description of Artificial Sequence: Synthetic oligonucleotide
  modified_base (20)..(21): 2'-methoxy-nucleotide
ucucauucaaccgccuaguuu

SEQ ID NO: 2716 - RNA, 21 nt, Artificial Sequence
  Description of Artificial Sequence: Synthetic oligonucleotide
  modified_base (20)..(21): 2'-methoxy-nucleotide
cucucauucaaccgccuaguu

SEQ ID NO: 2717 - RNA, 21 nt, Artificial Sequence
  Description of Artificial Sequence: Synthetic oligonucleotide
  modified_base (20)..(21): 2'-methoxy-nucleotide
ccucucauucaaccgccuauu

SEQ ID NO: 2718 - RNA, 21 nt, Artificial Sequence
  Description of Artificial Sequence: Synthetic oligonucleotide
  modified_base (20)..(21): 2'-methoxy-nucleotide
accucucauucaaccgccuuu

SEQ ID NO: 2719 - RNA, 21 nt, Artificial Sequence
  Description of Artificial Sequence: Synthetic oligonucleotide
  modified_base (20)..(21): 2'-methoxy-nucleotide
aaccucucauucaaccgccuu

SEQ ID NO: 2720 - RNA, 21 nt, Artificial Sequence
  Description of Artificial Sequence: Synthetic oligonucleotide
  modified_base (20)..(21): 2'-methoxy-nucleotide
gaaccucucauucaaccgcuu

SEQ ID NO: 2721 - RNA, 21 nt, Artificial Sequence
  Description of Artificial Sequence: Synthetic oligonucleotide
  modified_base (20)..(21): 2'-methoxy-nucleotide
ggaaccucucauucaaccguu

SEQ ID NO: 2722 - RNA, 21 nt, Artificial Sequence
  Description of Artificial Sequence: Synthetic oligonucleotide
  modified_base (20)..(21): 2'-methoxy-nucleotide
aggaaccucucauucaaccuu

SEQ ID NO: 2723 - RNA, 21 nt, Artificial Sequence
  Description of Artificial Sequence: Synthetic oligonucleotide
  modified_base (20)..(21): 2'-methoxy-nucleotide
uaggaaccucucauucaacuu

SEQ ID NO: 2724 - RNA, 21 nt, Artificial Sequence
  Description of Artificial Sequence: Synthetic oligonucleotide
  modified_base (20)..(21): 2'-methoxy-nucleotide
uuaggaaccucucauucaauu

SEQ ID NO: 2725 - RNA, 21 nt, Artificial Sequence
  Description of Artificial Sequence: Synthetic oligonucleotide
  modified_base (20)..(21): 2'-methoxy-nucleotide
cuuaggaaccucucauucauu

SEQ ID NO: 2726 - RNA, 21 nt, Artificial Sequence
  Description of Artificial Sequence: Synthetic oligonucleotide
  modified_base (20)..(21): 2'-methoxy-nucleotide
ucuuaggaaccucucauucuu

SEQ ID NO: 2727 - RNA, 21 nt, Artificial Sequence
  Description of Artificial Sequence: Synthetic oligonucleotide
  modified_base (20)..(21): 2'-methoxy-nucleotide
cucuuaggaaccucucauuuu

SEQ ID NO: 2728 - RNA, 21 nt, Artificial Sequence
  Description of Artificial Sequence: Synthetic oligonucleotide
  modified_base (20)..(21): 2'-methoxy-nucleotide
acucuuaggaaccucucauuu

SEQ ID NO: 2729 - RNA, 21 nt, Artificial Sequence
  Description of Artificial Sequence: Synthetic oligonucleotide
  modified_base (20)..(21): 2'-methoxy-nucleotide
cacucuuaggaaccucucauu

SEQ ID NO: 2730 - RNA, 21 nt, Artificial Sequence
  Description of Artificial Sequence: Synthetic oligonucleotide
  modified_base (20)..(21): 2'-methoxy-nucleotide
gcacucuuaggaaccucucuu

SEQ ID NO: 2731 - RNA, 21 nt, Artificial Sequence
  Description of Artificial Sequence: Synthetic oligonucleotide
  modified_base (20)..(21): 2'-methoxy-nucleotide
agcacucuuaggaaccucuuu

SEQ ID NO: 2732 - RNA, 21 nt, Artificial Sequence
  Description of Artificial Sequence: Synthetic oligonucleotide
  modified_base (20)..(21): 2'-methoxy-nucleotide
cagcacucuuaggaaccucuu

SEQ ID NO: 2733 - RNA, 21 nt, Artificial Sequence
  Description of Artificial Sequence: Synthetic oligonucleotide
  modified_base (20)..(21): 2'-methoxy-nucleotide
ccagcacucuuaggaaccuuu

SEQ ID NO: 2734 - RNA, 21 nt, Artificial Sequence
  Description of Artificial Sequence: Synthetic oligonucleotide
  modified_base (20)..(21): 2'-methoxy-nucleotide
cccagcacucuuaggaaccuu

SEQ ID NO: 2735 - RNA, 21 nt, Artificial Sequence
  Description of Artificial Sequence: Synthetic oligonucleotide
  modified_base (20)..(21): 2'-methoxy-nucleotide
gcccagcacucuuaggaacuu

SEQ ID NO: 2736 - RNA, 21 nt, Artificial Sequence
  Description of Artificial Sequence: Synthetic oligonucleotide
  modified_base (20)..(21): 2'-methoxy-nucleotide
ugcccagcacucuuaggaauu

SEQ ID NO: 2737 - RNA, 21 nt, Artificial Sequence
  Description of Artificial Sequence: Synthetic oligonucleotide
  modified_base (20)..(21): 2'-methoxy-nucleotide
aaugcccagcacucuuagguu

SEQ ID NO: 2738 - RNA, 21 nt, Artificial Sequence
  Description of Artificial Sequence: Synthetic oligonucleotide
  modified_base (20)..(21): 2'-methoxy-nucleotide
aaaugcccagcacucuuaguu

SEQ ID NO: 2739 - RNA, 21 nt, Artificial Sequence
  Description of Artificial Sequence: Synthetic oligonucleotide
  modified_base (20)..(21): 2'-methoxy-nucleotide
aaaaugcccagcacucuuauu

SEQ ID NO: 2740 - RNA, 21 nt, Artificial Sequence
  Description of Artificial Sequence: Synthetic oligonucleotide
  modified_base (20)..(21): 2'-methoxy-nucleotide
aaaaaugcccagcacucuuuu

SEQ ID NO: 2741 - RNA, 21 nt, Artificial Sequence
  Description of Artificial Sequence: Synthetic oligonucleotide
  modified_base (20)..(21): 2'-methoxy-nucleotide
uaaaaaugcccagcacucuuu

SEQ ID NO: 2742 - RNA, 21 nt, Artificial Sequence
  Description of Artificial Sequence: Synthetic oligonucleotide
  modified_base (20)..(21): 2'-methoxy-nucleotide
auaaaaaugcccagcacucuu

SEQ ID NO: 2743 - RNA, 21 nt, Artificial Sequence
  Description of Artificial Sequence: Synthetic oligonucleotide
  modified_base (20)..(21): 2'-methoxy-nucleotide
aauaaaaaugcccagcacuuu

SEQ ID NO: 2744 - RNA, 21 nt, Artificial Sequence
  Description of Artificial Sequence: Synthetic oligonucleotide
  modified_base (20)..(21): 2'-methoxy-nucleotide
aaauaaaaaugcccagcacuu

SEQ ID NO: 2745 - RNA, 21 nt, Artificial Sequence
  Description of Artificial Sequence: Synthetic oligonucleotide
  modified_base (20)..(21): 2'-methoxy-nucleotide
aaaauaaaaaugcccagcauu

SEQ ID NO: 2746 - RNA, 21 nt, Artificial Sequence
  Description of Artificial Sequence: Synthetic oligonucleotide
  modified_base (20)..(21): 2'-methoxy-nucleotide
uaaaauaaaaaugcccagcuu

SEQ ID NO: 2747 - RNA, 21 nt, Artificial Sequence
  Description of Artificial Sequence: Synthetic oligonucleotide
  modified_base (20)..(21): 2'-methoxy-nucleotide
auaaaauaaaaaugcccaguu

SEQ ID NO: 2748 - RNA, 21 nt, Artificial Sequence
  Description of Artificial Sequence: Synthetic oligonucleotide
  modified_base (20)..(21): 2'-methoxy-nucleotide
cauaaaauaaaaaugcccauu

SEQ ID NO: 2749 - RNA, 21 nt, Artificial Sequence
  Description of Artificial Sequence: Synthetic oligonucleotide
  modified_base (20)..(21): 2'-methoxy-nucleotide
ucauaaaauaaaaaugcccuu

SEQ ID NO: 2750 - RNA, 21 nt, Artificial Sequence
  Description of Artificial Sequence: Synthetic oligonucleotide
  modified_base (20)..(21): 2'-methoxy-nucleotide
uucauaaaauaaaaaugccuu

SEQ ID NO: 2751 - RNA, 21 nt, Artificial Sequence
  Description of Artificial Sequence: Synthetic oligonucleotide
  modified_base (20)..(21): 2'-methoxy-nucleotide
uuucauaaaauaaaaaugcuu

SEQ ID NO: 2752 - RNA, 21 nt, Artificial Sequence
  Description of Artificial Sequence: Synthetic oligonucleotide
  modified_base (20)..(21): 2'-methoxy-nucleotide
auuucauaaaauaaaaauguu

SEQ ID NO: 2753 - RNA, 21 nt, Artificial Sequence
  Description of Artificial Sequence: Synthetic oligonucleotide
  modified_base (20)..(21): 2'-methoxy-nucleotide
uauuucauaaaauaaaaauuu

SEQ ID NO: 2754 - RNA, 21 nt, Artificial Sequence
  Description of Artificial Sequence: Synthetic oligonucleotide
  modified_base (20)..(21): 2'-methoxy-nucleotide
guauuucauaaaauaaaaauu

SEQ ID NO: 2755 - RNA, 21 nt, Artificial Sequence
  Description of Artificial Sequence: Synthetic oligonucleotide
  modified_base (20)..(21): 2'-methoxy-nucleotide
aguauuucauaaaauaaaauu

SEQ ID NO: 2756 - RNA, 21 nt, Artificial Sequence
  Description of Artificial Sequence: Synthetic oligonucleotide
  modified_base (20)..(21): 2'-methoxy-nucleotide
uaguauuucauaaaauaaauu

SEQ ID NO: 2757 - RNA, 21 nt, Artificial Sequence
  Description of Artificial Sequence: Synthetic oligonucleotide
  modified_base (20)..(21): 2'-methoxy-nucleotide
auaguauuucauaaaauaauu

SEQ ID NO: 2758 - RNA, 21 nt, Artificial Sequence
  Description of Artificial Sequence: Synthetic oligonucleotide
  modified_base (20)..(21): 2'-methoxy-nucleotide
aauaguauuucauaaaauauu

SEQ ID NO: 2759 - RNA, 21 nt, Artificial Sequence
  Description of Artificial Sequence: Synthetic oligonucleotide
  modified_base (20)..(21): 2'-methoxy-nucleotide
aaauaguauuucauaaaauuu

SEQ ID NO: 2760 - RNA, 21 nt, Artificial Sequence
  Description of Artificial Sequence: Synthetic oligonucleotide
  modified_base (20)..(21): 2'-methoxy-nucleotide
uaaauaguauuucauaaaauu

SEQ ID NO: 2761 - RNA, 21 nt, Artificial Sequence
  Description of Artificial Sequence: Synthetic oligonucleotide
  modified_base (20)..(21): 2'-methoxy-nucleotide
uuaaauaguauuucauaaauu

SEQ ID NO: 2762 - RNA, 21 nt, Artificial Sequence
  Description of Artificial Sequence: Synthetic oligonucleotide
  modified_base (20)..(21): 2'-methoxy-nucleotide
uuuaaauaguauuucauaauu

SEQ ID NO: 2763 - RNA, 21 nt, Artificial Sequence
  Description of Artificial Sequence: Synthetic oligonucleotide
  modified_base (20)..(21): 2'-methoxy-nucleotide
cuuuaaauaguauuucauauu

SEQ ID NO: 2764 - RNA, 21 nt, Artificial Sequence
  Description of Artificial Sequence: Synthetic oligonucleotide
  modified_base (20)..(21): 2'-methoxy-nucleotide
gcuuuaaauaguauuucauuu

SEQ ID NO: 2765 - RNA, 21 nt, Artificial Sequence
  Description of Artificial Sequence: Synthetic oligonucleotide
  modified_base (20)..(21): 2'-methoxy-nucleotide
ggcuuuaaauaguauuucauu

SEQ ID NO: 2766 - RNA, 21 nt, Artificial Sequence
  Description of Artificial Sequence: Synthetic oligonucleotide
  modified_base (20)..(21): 2'-methoxy-nucleotide
aggcuuuaaauaguauuucuu

SEQ ID NO: 2767 - RNA, 21 nt, Artificial Sequence
  Description of Artificial Sequence: Synthetic oligonucleotide
  modified_base (20)..(21): 2'-methoxy-nucleotide
gaggcuuuaaauaguauuuuu

SEQ ID NO: 2768 - RNA, 21 nt, Artificial Sequence
  Description of Artificial Sequence: Synthetic oligonucleotide
  modified_base (20)..(21): 2'-methoxy-nucleotide
ggaggcuuuaaauaguauuuu

SEQ ID NO: 2769 - RNA, 21 nt, Artificial Sequence
  Description of Artificial Sequence: Synthetic oligonucleotide
  modified_base (20)..(21): 2'-methoxy-nucleotide
aggaggcuuuaaauaguauuu

SEQ ID NO: 2770 - RNA, 21 nt, Artificial Sequence
  Description of Artificial Sequence: Synthetic oligonucleotide
  modified_base (20)..(21): 2'-methoxy-nucleotide
gaggaggcuuuaaauaguauu

SEQ ID NO: 2771 - RNA, 21 nt, Artificial Sequence
  Description of Artificial Sequence: Synthetic oligonucleotide
  modified_base (20)..(21): 2'-methoxy-nucleotide
ugaggaggcuuuaaauaguuu

SEQ ID NO: 2772 - RNA, 21 nt, Artificial Sequence
  Description of Artificial Sequence: Synthetic oligonucleotide
  modified_base (20)..(21): 2'-methoxy-nucleotide
augaggaggcuuuaaauaguu

SEQ ID NO: 2773 - RNA, 21 nt, Artificial Sequence
  Description of Artificial Sequence: Synthetic oligonucleotide
  modified_base (20)..(21): 2'-methoxy-nucleotide
gaugaggaggcuuuaaauauu

SEQ ID NO: 2774 - RNA, 21 nt, Artificial Sequence
  Description of Artificial Sequence: Synthetic oligonucleotide
  modified_base (20)..(21): 2'-methoxy-nucleotide
ggaugaggaggcuuuaaauuu

SEQ ID NO: 2775 - RNA, 21 nt, Artificial Sequence
  Description of Artificial Sequence: Synthetic oligonucleotide
  modified_base (20)..(21): 2'-methoxy-nucleotide
gggaugaggaggcuuuaaauu

SEQ ID NO: 2776 - RNA, 21 nt, Artificial Sequence
  Description of Artificial Sequence: Synthetic oligonucleotide
  modified_base (20)..(21): 2'-methoxy-nucleotide
cgggaugaggaggcuuuaauu

SEQ ID NO: 2777 - RNA, 21 nt, Artificial Sequence
  Description of Artificial Sequence: Synthetic oligonucleotide
  modified_base (20)..(21): 2'-methoxy-nucleotide
acgggaugaggaggcuuuauu

SEQ ID NO: 2778 - RNA, 21 nt, Artificial Sequence
  Description of Artificial Sequence: Synthetic oligonucleotide
  modified_base (20)..(21): 2'-methoxy-nucleotide
cacgggaugaggaggcuuuuu

SEQ ID NO: 2779 - RNA, 21 nt, Artificial Sequence
  Description of Artificial Sequence: Synthetic oligonucleotide
  modified_base (20)..(21): 2'-methoxy-nucleotide
acacgggaugaggaggcuuuu

SEQ ID NO: 2780 - RNA, 21 nt, Artificial Sequence
  Description of Artificial Sequence: Synthetic oligonucleotide
  modified_base (20)..(21): 2'-methoxy-nucleotide
aacacgggaugaggaggcuuu

SEQ ID NO: 2781 - RNA, 21 nt, Artificial Sequence
  Description of Artificial Sequence: Synthetic oligonucleotide
  modified_base (20)..(21): 2'-methoxy-nucleotide
gaacacgggaugaggaggcuu

SEQ ID NO: 2782 - RNA, 21 nt, Artificial Sequence
  Description of Artificial Sequence: Synthetic oligonucleotide
  modified_base (20)..(21): 2'-methoxy-nucleotide
agaacacgggaugaggagguu

SEQ ID NO: 2783 - RNA, 21 nt, Artificial Sequence
  Description of Artificial Sequence: Synthetic oligonucleotide
  modified_base (20)..(21): 2'-methoxy-nucleotide
gagaacacgggaugaggaguu

SEQ ID NO: 2784 - RNA, 21 nt, Artificial Sequence
  Description of Artificial Sequence: Synthetic oligonucleotide
  modified_base (20)..(21): 2'-methoxy-nucleotide
ggagaacacgggaugaggauu

SEQ ID NO: 2785 - RNA, 21 nt, Artificial Sequence
  Description of Artificial Sequence: Synthetic oligonucleotide
  modified_base (20)..(21): 2'-methoxy-nucleotide
aggagaacacgggaugagguu

SEQ ID NO: 2786 - RNA, 21 nt, Artificial Sequence
  Description of Artificial Sequence: Synthetic oligonucleotide
  modified_base (20)..(21): 2'-methoxy-nucleotide
aaggagaacacgggaugaguu

SEQ ID NO: 2787 - RNA, 21 nt, Artificial Sequence
  Description of Artificial Sequence: Synthetic oligonucleotide
  modified_base (20)..(21): 2'-methoxy-nucleotide
aaaggagaacacgggaugauu

SEQ ID NO: 2788 - RNA, 21 nt, Artificial Sequence
  Description of Artificial Sequence: Synthetic oligonucleotide
  modified_base (20)..(21): 2'-methoxy-nucleotide
aaaaggagaacacgggauguu

SEQ ID NO: 2789 - RNA, 21 nt, Artificial Sequence
  Description of Artificial Sequence: Synthetic oligonucleotide
  modified_base (20)..(21): 2'-methoxy-nucleotide
gaaaaggagaacacgggauuu

SEQ ID NO: 2790 - RNA, 21 nt, Artificial Sequence
  Description of Artificial Sequence: Synthetic oligonucleotide
  modified_base (20)..(21): 2'-methoxy-nucleotide
ggaaaaggagaacacgggauu

SEQ ID NO: 2791 - RNA, 21 nt, Artificial Sequence
  Description of Artificial Sequence: Synthetic oligonucleotide
  modified_base (20)..(21): 2'-methoxy-nucleotide
aggaaaaggagaacacggguu

SEQ ID NO: 2792 - RNA, 21 nt, Artificial Sequence
  Description of Artificial Sequence: Synthetic oligonucleotide
  modified_base (20)..(21): 2'-methoxy-nucleotide
gaggaaaaggagaacacgguu

SEQ ID NO: 2793 - RNA, 21 nt, Artificial Sequence
  Description of Artificial Sequence: Synthetic oligonucleotide
  modified_base (20)..(21): 2'-methoxy-nucleotide
agaggaaaaggagaacacguu

SEQ ID NO: 2794 - RNA, 21 nt, Artificial Sequence
  Description of Artificial Sequence: Synthetic oligonucleotide
  modified_base (20)..(21): 2'-methoxy-nucleotide
gagaggaaaaggagaacacuu

SEQ ID NO: 2795 - RNA, 21 nt, Artificial Sequence
  Description of Artificial Sequence: Synthetic oligonucleotide
  modified_base (20)..(21): 2'-methoxy-nucleotide
agagaggaaaaggagaacauu

SEQ ID NO: 2796 - RNA, 21 nt, Artificial Sequence
  Description of Artificial Sequence: Synthetic oligonucleotide
  modified_base (20)..(21): 2'-methoxy-nucleotide
gagagaggaaaaggagaacuu

SEQ ID NO: 2797 - RNA, 21 nt, Artificial Sequence
  Description of Artificial Sequence: Synthetic oligonucleotide
  modified_base (20)..(21): 2'-methoxy-nucleotide
ggagagaggaaaaggagaauu

SEQ ID NO: 2798 - RNA, 21 nt, Artificial Sequence
  Description of Artificial Sequence: Synthetic oligonucleotide
  modified_base (20)..(21): 2'-methoxy-nucleotide
gggagagaggaaaaggagauu

SEQ ID NO: 2799 - RNA, 21 nt, Artificial Sequence
  Description of Artificial Sequence: Synthetic oligonucleotide
  modified_base (20)..(21): 2'-methoxy-nucleotide
cgggagagaggaaaaggaguu

SEQ ID NO: 2800 - RNA, 21 nt, Artificial Sequence
  Description of Artificial Sequence: Synthetic oligonucleotide
  modified_base (20)..(21): 2'-methoxy-nucleotide
ccgggagagaggaaaaggauu

SEQ ID NO: 2801 - RNA, 21 nt, Artificial Sequence
  Description of Artificial Sequence: Synthetic oligonucleotide
  modified_base (20)..(21): 2'-methoxy-nucleotide
uccgggagagaggaaaagguu

SEQ ID NO: 2802 - RNA, 21 nt, Artificial Sequence
  Description of Artificial Sequence: Synthetic oligonucleotide
  modified_base (20)..(21): 2'-methoxy-nucleotide
cuccgggagagaggaaaaguu

SEQ ID NO: 2803 - RNA, 21 nt, Artificial Sequence
  Description of Artificial Sequence: Synthetic oligonucleotide
  modified_base (20)..(21): 2'-methoxy-nucleotide
ccuccgggagagaggaaaauu

SEQ ID NO: 2804 - RNA, 21 nt, Artificial Sequence
  Description of Artificial Sequence: Synthetic oligonucleotide
  modified_base (20)..(21): 2'-methoxy-nucleotide
accuccgggagagaggaaauu

SEQ ID NO: 2805 - RNA, 21 nt, Artificial Sequence
  Description of Artificial Sequence: Synthetic oligonucleotide
  modified_base (20)..(21): 2'-methoxy-nucleotide
aaccuccgggagagaggaauu

SEQ ID NO: 2806 - RNA, 21 nt, Artificial Sequence
  Description of Artificial Sequence: Synthetic oligonucleotide
  modified_base (20)..(21): 2'-methoxy-nucleotide
caaccuccgggagagaggauu

SEQ ID NO: 2807 - RNA, 21 nt, Artificial Sequence
  Description of Artificial Sequence: Synthetic oligonucleotide
  modified_base (20)..(21): 2'-methoxy-nucleotide
ccaaccuccgggagagagguu

SEQ ID NO: 2808 - RNA, 21 nt, Artificial Sequence
  Description of Artificial Sequence: Synthetic oligonucleotide
  modified_base (20)..(21): 2'-methoxy-nucleotide
cccaaccuccgggagagaguu

SEQ ID NO: 2809 - RNA, 21 nt, Artificial Sequence
  Description of Artificial Sequence: Synthetic oligonucleotide
  modified_base (20)..(21): 2'-methoxy-nucleotide
acccaaccuccgggagagauu

SEQ ID NO: 2810 - RNA, 21 nt, Artificial Sequence
  Description of Artificial Sequence: Synthetic oligonucleotide
  modified_base (20)..(21): 2'-methoxy-nucleotide
cacccaaccuccgggagaguu

SEQ ID NO: 2811 - RNA, 21 nt, Artificial Sequence
  Description of Artificial Sequence: Synthetic oligonucleotide
  modified_base (20)..(21): 2'-methoxy-nucleotide
ccacccaaccuccgggagauu

SEQ ID NO: 2812 - RNA, 21 nt, Artificial Sequence
  Description of Artificial Sequence: Synthetic oligonucleotide
  modified_base (20)..(21): 2'-methoxy-nucleotide
cccacccaaccuccgggaguu

SEQ ID NO: 2813 - RNA, 21 nt, Artificial Sequence
  Description of Artificial Sequence: Synthetic oligonucleotide
  modified_base (20)..(21): 2'-methoxy-nucleotide
gcccacccaaccuccgggauu

SEQ ID NO: 2814 - RNA, 21 nt, Artificial Sequence
  Description of Artificial Sequence: Synthetic oligonucleotide
  modified_base (20)..(21): 2'-methoxy-nucleotide
ggcccacccaaccuccggguu

SEQ ID NO: 2815 - RNA, 21 nt, Artificial Sequence
  Description of Artificial Sequence: Synthetic oligonucleotide
  modified_base (20)..(21): 2'-methoxy-nucleotide
cggcccacccaaccuccgguu

SEQ ID NO: 2816 - RNA, 21 nt, Artificial Sequence
  Description of Artificial Sequence: Synthetic oligonucleotide
  modified_base (20)..(21): 2'-methoxy-nucleotide
ccggcccacccaaccuccguu

SEQ ID NO: 2817 - RNA, 21 nt, Artificial Sequence
  Description of Artificial Sequence: Synthetic oligonucleotide
  modified_base (20)..(21): 2'-methoxy-nucleotide
gccggcccacccaaccuccuu

SEQ ID NO: 2818 - RNA, 21 nt, Artificial Sequence
  Description of Artificial Sequence: Synthetic oligonucleotide
  modified_base (20)..(21): 2'-methoxy-nucleotide
agccggcccacccaaccucuu

SEQ ID NO: 2819 - RNA, 21 nt, Artificial Sequence
  Description of Artificial Sequence: Synthetic oligonucleotide
  modified_base (20)..(21): 2'-methoxy-nucleotide
aagccggcccacccaaccuuu

SEQ ID NO: 2820 - RNA, 21 nt, Artificial Sequence
  Description of Artificial Sequence: Synthetic oligonucleotide
  modified_base (20)..(21): 2'-methoxy-nucleotide
gaagccggcccacccaaccuu

SEQ ID NO: 2821 - RNA, 21 nt, Artificial Sequence
  Description of Artificial Sequence: Synthetic oligonucleotide
  modified_base (20)..(21): 2'-methoxy-nucleotide
ugaagccggcccacccaacuu

SEQ ID NO: 2822 - RNA, 21 nt, Artificial Sequence
  Description of Artificial Sequence: Synthetic oligonucleotide
  modified_base (20)..(21): 2'-methoxy-nucleotide
augaagccggcccacccaauu

SEQ ID NO: 2823 - RNA, 21 nt, Artificial Sequence
  Description of Artificial Sequence: Synthetic oligonucleotide
  modified_base (20)..(21): 2'-methoxy-nucleotide
caugaagccggcccacccauu

SEQ ID NO: 2824 - RNA, 21 nt, Artificial Sequence
  Description of Artificial Sequence: Synthetic oligonucleotide
  modified_base (20)..(21): 2'-methoxy-nucleotide
gcaugaagccggcccacccuu

SEQ ID NO: 2825 - RNA, 21 nt, Artificial Sequence
  Description of Artificial Sequence: Synthetic oligonucleotide
  modified_base (20)..(21): 2'-methoxy-nucleotide
ggcaugaagccggcccaccuu

SEQ ID NO: 2826 - RNA, 21 nt, Artificial Sequence
  Description of Artificial Sequence: Synthetic oligonucleotide
  modified_base (20)..(21): 2'-methoxy-nucleotide
uggcaugaagccggcccacuu

SEQ ID NO: 2827 - RNA, 21 nt, Artificial Sequence
  Description of Artificial Sequence: Synthetic oligonucleotide
  modified_base (20)..(21): 2'-methoxy-nucleotide
cuggcaugaagccggcccauu

SEQ ID NO: 2828 - RNA, 21 nt, Artificial Sequence
  Description of Artificial Sequence: Synthetic oligonucleotide
  modified_base (20)..(21): 2'-methoxy-nucleotide
gcuggcaugaagccggcccuu

SEQ ID NO: 2829 - RNA, 21 nt, Artificial Sequence
  Description of Artificial Sequence: Synthetic oligonucleotide
  modified_base (20)..(21): 2'-methoxy-nucleotide
agcuggcaugaagccggccuu

SEQ ID NO: 2830 - RNA, 21 nt, Artificial Sequence
  Description of Artificial Sequence: Synthetic oligonucleotide
  modified_base (20)..(21): 2'-methoxy-nucleotide
uagcuggcaugaagccggcuu

SEQ ID NO: 2831 - RNA, 21 nt, Artificial Sequence
  Description of Artificial Sequence: Synthetic oligonucleotide
  modified_base (20)..(21): 2'-methoxy-nucleotide
guagcuggcaugaagccgguu

SEQ ID NO: 2832 - RNA, 21 nt, Artificial Sequence
  Description of Artificial Sequence: Synthetic oligonucleotide
  modified_base (20)..(21): 2'-methoxy-nucleotide
aguagcuggcaugaagccguu

SEQ ID NO: 2833 - RNA, 21 nt, Artificial Sequence
  Description of Artificial Sequence: Synthetic oligonucleotide
  modified_base (20)..(21): 2'-methoxy-nucleotide
aaguagcuggcaugaagccuu

SEQ ID NO: 2834 - RNA, 21 nt, Artificial Sequence
  Description of Artificial Sequence: Synthetic oligonucleotide
  modified_base (20)..(21): 2'-methoxy-nucleotide
gaaguagcuggcaugaagcuu

SEQ ID NO: 2835 - RNA, 21 nt, Artificial Sequence
  Description of Artificial Sequence: Synthetic oligonucleotide
  modified_base (20)..(21): 2'-methoxy-nucleotide
ggaaguagcuggcaugaaguu

SEQ ID NO: 2836 - RNA, 21 nt, Artificial Sequence
  Description of Artificial Sequence: Synthetic oligonucleotide
  modified_base (20)..(21): 2'-methoxy-nucleotide
aggaaguagcuggcaugaauu

SEQ ID NO: 2837 - RNA, 21 nt, Artificial Sequence
  Description of Artificial Sequence: Synthetic oligonucleotide
  modified_base (20)..(21): 2'-methoxy-nucleotide
gaggaaguagcuggcaugauu

SEQ ID NO: 2838 - RNA, 21 nt, Artificial Sequence
  Description of Artificial Sequence: Synthetic oligonucleotide
  modified_base (20)..(21): 2'-methoxy-nucleotide
ggaggaaguagcuggcauguu

SEQ ID NO: 2839 - RNA, 21 nt, Artificial Sequence
  Description of Artificial Sequence: Synthetic oligonucleotide
  modified_base (20)..(21): 2'-methoxy-nucleotide
aggaggaaguagcuggcauuu

SEQ ID NO: 2840 - RNA, 21 nt, Artificial Sequence
  Description of Artificial Sequence: Synthetic oligonucleotide
  modified_base (20)..(21): 2'-methoxy-nucleotide
gaggaggaaguagcuggcauu

SEQ ID NO: 2841 - RNA, 21 nt, Artificial Sequence
  Description of Artificial Sequence: Synthetic oligonucleotide
  modified_base (20)..(21): 2'-methoxy-nucleotide
ggaggaggaaguagcuggcuu

SEQ ID NO: 2842 - RNA, 21 nt, Artificial Sequence
  Description of Artificial Sequence: Synthetic oligonucleotide
  modified_base (20)..(21): 2'-methoxy-nucleotide
gggaggaggaaguagcugguu

SEQ ID NO: 2843 - RNA, 21 nt, Artificial Sequence
  Description of Artificial Sequence: Synthetic oligonucleotide
  modified_base (20)..(21): 2'-methoxy-nucleotide
ggggaggaggaaguagcuguu

SEQ ID NO: 2844 - RNA, 21 nt, Artificial Sequence
  Description of Artificial Sequence: Synthetic oligonucleotide
  modified_base (20)..(21): 2'-methoxy-nucleotide
uggggaggaggaaguagcuuu

SEQ ID NO: 2845 - RNA, 21 nt, Artificial Sequence
  Description of Artificial Sequence: Synthetic oligonucleotide
  modified_base (20)..(21): 2'-methoxy-nucleotide
guggggaggaggaaguagcuu

SEQ ID NO: 2846 - RNA, 21 nt, Artificial Sequence
  Description of Artificial Sequence: Synthetic oligonucleotide
  modified_base (20)..(21): 2'-methoxy-nucleotide
aguggggaggaggaaguaguu

SEQ ID NO: 2847 - RNA, 21 nt, Artificial Sequence
  Description of Artificial Sequence: Synthetic oligonucleotide
  modified_base (20)..(21): 2'-methoxy-nucleotide
aaguggggaggaggaaguauu

SEQ ID NO: 2848 - RNA, 21 nt, Artificial Sequence
  Description of Artificial Sequence: Synthetic oligonucleotide
  modified_base (20)..(21): 2'-methoxy-nucleotide
caaguggggaggaggaaguuu

SEQ ID NO: 2849 - RNA, 21 nt, Artificial Sequence
  Description of Artificial Sequence: Synthetic oligonucleotide
  modified_base (20)..(21): 2'-methoxy-nucleotide
acaaguggggaggaggaaguu

SEQ ID NO: 2850 - RNA, 21 nt, Artificial Sequence
  Description of Artificial Sequence: Synthetic oligonucleotide
  modified_base (20)..(21): 2'-methoxy-nucleotide
gacaaguggggaggaggaauu

SEQ ID NO: 2851 - RNA, 21 nt, Artificial Sequence
  Description of Artificial Sequence: Synthetic oligonucleotide
  modified_base (20)..(21): 2'-methoxy-nucleotide
ggacaaguggggaggaggauu

SEQ ID NO: 2852 - RNA, 21 nt, Artificial Sequence
  Description of Artificial Sequence: Synthetic oligonucleotide
  modified_base (20)..(21): 2'-methoxy-nucleotide
cggacaaguggggaggagguu

SEQ ID NO: 2853 - RNA, 21 nt, Artificial Sequence
  Description of Artificial Sequence: Synthetic oligonucleotide
  modified_base (20)..(21): 2'-methoxy-nucleotide
gcggacaaguggggaggaguu

SEQ ID NO: 2854 - RNA, 21 nt, Artificial Sequence
  Description of Artificial Sequence: Synthetic oligonucleotide
  modified_base (20)..(21): 2'-methoxy-nucleotide
agcggacaaguggggaggauu

SEQ ID NO: 2855 - RNA, 21 nt, Artificial Sequence
  Description of Artificial Sequence: Synthetic oligonucleotide
  modified_base (20)..(21): 2'-methoxy-nucleotide
cagcggacaaguggggagguu

SEQ ID NO: 2856 - RNA, 21 nt, Artificial Sequence
  Description of Artificial Sequence: Synthetic oligonucleotide
  modified_base (20)..(21): 2'-methoxy-nucleotide
ccagcggacaaguggggaguu

SEQ ID NO: 2857 - RNA, 21 nt, Artificial Sequence
  Description of Artificial Sequence: Synthetic oligonucleotide
  modified_base (20)..(21): 2'-methoxy-nucleotide
cccagcggacaaguggggauu

SEQ ID NO: 2858 - RNA, 21 nt, Artificial Sequence
  Description of Artificial Sequence: Synthetic oligonucleotide
  modified_base (20)..(21): 2'-methoxy-nucleotide
acccagcggacaagugggguu

SEQ ID NO: 2859 - RNA, 21 nt, Artificial Sequence
  Description of Artificial Sequence: Synthetic oligonucleotide
  modified_base (20)..(21): 2'-methoxy-nucleotide
cacccagcggacaaguggguu

SEQ ID NO: 2860 - RNA, 21 nt, Artificial Sequence
  Description of Artificial Sequence: Synthetic oligonucleotide
  modified_base (20)..(21): 2'-methoxy-nucleotide
ccacccagcggacaagugguu

SEQ ID NO: 2861 - RNA, 21 nt, Artificial Sequence
  Description of Artificial Sequence: Synthetic oligonucleotide
  modified_base (20)..(21): 2'-methoxy-nucleotide
accacccagcggacaaguguu

SEQ ID NO: 2862 - RNA, 21 nt, Artificial Sequence
  Description of Artificial Sequence: Synthetic oligonucleotide
  modified_base (20)..(21): 2'-methoxy-nucleotide
uaccacccagcggacaaguuu

SEQ ID NO: 2863 - RNA, 21 nt, Artificial Sequence
  Description of Artificial Sequence: Synthetic oligonucleotide
  modified_base (20)..(21): 2'-methoxy-nucleotide
guaccacccagcggacaaguu

SEQ ID NO: 2864 - RNA, 21 nt, Artificial Sequence
  Description of Artificial Sequence: Synthetic oligonucleotide
  modified_base (20)..(21): 2'-methoxy-nucleotide
gguaccacccagcggacaauu

SEQ ID NO: 2865 - RNA, 21 nt, Artificial Sequence
  Description of Artificial Sequence: Synthetic oligonucleotide
  modified_base (20)..(21): 2'-methoxy-nucleotide
ggguaccacccagcggacauu

SEQ ID NO: 2866 - RNA, 21 nt, Artificial Sequence
  Description of Artificial Sequence: Synthetic oligonucleotide
  modified_base (20)..(21): 2'-methoxy-nucleotide
aggguaccacccagcggacuu

SEQ ID NO: 2867 - RNA, 21 nt, Artificial Sequence
  Description of Artificial Sequence: Synthetic oligonucleotide
  modified_base (20)..(21): 2'-methoxy-nucleotide
gaggguaccacccagcggauu

SEQ ID NO: 2868 - RNA, 21 nt, Artificial Sequence
  Description of Artificial Sequence: Synthetic oligonucleotide
  modified_base (20)..(21): 2'-methoxy-nucleotide
agaggguaccacccagcgguu

SEQ ID NO: 2869 - RNA, 21 nt, Artificial Sequence
  Description of Artificial Sequence: Synthetic oligonucleotide
  modified_base (20)..(21): 2'-methoxy-nucleotide
cagaggguaccacccagcguu

SEQ ID NO: 2870 - RNA, 21 nt, Artificial Sequence
  Description of Artificial Sequence: Synthetic oligonucleotide
  modified_base (20)..(21): 2'-methoxy-nucleotide
ccagaggguaccacccagcuu

SEQ ID NO: 2871 - RNA, 21 nt, Artificial Sequence
  Description of Artificial Sequence: Synthetic oligonucleotide
  modified_base (20)..(21): 2'-methoxy-nucleotide
uccagaggguaccacccaguu

SEQ ID NO: 2872 - RNA, 21 nt, Artificial Sequence
  Description of Artificial Sequence: Synthetic oligonucleotide
  modified_base (20)..(21): 2'-methoxy-nucleotide
cuccagaggguaccacccauu

SEQ ID NO: 2873 - RNA, 21 nt, Artificial Sequence
  Description of Artificial Sequence: Synthetic oligonucleotide
  modified_base (20)..(21): 2'-methoxy-nucleotide
ccuccagaggguaccacccuu

SEQ ID NO: 2874 - RNA, 21 nt, Artificial Sequence
  Description of Artificial Sequence: Synthetic oligonucleotide
  modified_base (20)..(21): 2'-methoxy-nucleotide
cccuccagaggguaccaccuu

SEQ ID NO: 2875 - RNA, 21 nt, Artificial Sequence
  Description of Artificial Sequence: Synthetic oligonucleotide
  modified_base (20)..(21): 2'-methoxy-nucleotide
ccccuccagaggguaccacuu

SEQ ID NO: 2876 - RNA, 21 nt, Artificial Sequence
  Description of Artificial Sequence: Synthetic oligonucleotide
  modified_base (20)..(21): 2'-methoxy-nucleotide
accccuccagaggguaccauu

SEQ ID NO: 2877 - RNA, 21 nt, Artificial Sequence
  Description of Artificial Sequence: Synthetic oligonucleotide
  modified_base (20)..(21): 2'-methoxy-nucleotide
caccccuccagaggguaccuu

SEQ ID NO: 2878 - RNA, 21 nt, Artificial Sequence
  Description of Artificial Sequence: Synthetic oligonucleotide
  modified_base (20)..(21): 2'-methoxy-nucleotide
acaccccuccagaggguacuu

SEQ ID NO: 2879 - RNA, 21 nt, Artificial Sequence
  Description of Artificial Sequence: Synthetic oligonucleotide
  modified_base (20)..(21): 2'-methoxy-nucleotide
cacaccccuccagaggguauu

SEQ ID NO: 2880 - RNA, 21 nt, Artificial Sequence
  Description of Artificial Sequence: Synthetic oligonucleotide
  modified_base (20)..(21): 2'-methoxy-nucleotide
ccacaccccuccagaggguuu

SEQ ID NO: 2881 - RNA, 21 nt, Artificial Sequence
  Description of Artificial Sequence: Synthetic oligonucleotide
  modified_base (20)..(21): 2'-methoxy-nucleotide
gccacaccccuccagaggguu

SEQ ID NO: 2882 - RNA, 21 nt, Artificial Sequence
  Description of Artificial Sequence: Synthetic oligonucleotide
  modified_base (20)..(21): 2'-methoxy-nucleotide
agccacaccccuccagagguu

SEQ ID NO: 2883 - RNA, 21 nt, Artificial Sequence
  Description of Artificial Sequence: Synthetic oligonucleotide
  modified_base (20)..(21): 2'-methoxy-nucleotide
gagccacaccccuccagaguu

SEQ ID NO: 2884 - RNA, 21 nt, Artificial Sequence
  Description of Artificial Sequence: Synthetic oligonucleotide
  modified_base (20)..(21): 2'-methoxy-nucleotide
ggagccacaccccuccagauu

SEQ ID NO: 2885 - RNA, 21 nt, Artificial Sequence
  Description of Artificial Sequence: Synthetic oligonucleotide
  modified_base (20)..(21): 2'-methoxy-nucleotide
aggagccacaccccuccaguu

SEQ ID NO: 2886 - RNA, 21 nt, Artificial Sequence
  Description of Artificial Sequence: Synthetic oligonucleotide
  modified_base (20)..(21): 2'-methoxy-nucleotide
aaggagccacaccccuccauu

SEQ ID NO: 2887 - RNA, 21 nt, Artificial Sequence
  Description of Artificial Sequence: Synthetic oligonucleotide
  modified_base (20)..(21): 2'-methoxy-nucleotide
gaaggagccacaccccuccuu

SEQ ID NO: 2888 - RNA, 21 nt, Artificial Sequence
  Description of Artificial Sequence: Synthetic oligonucleotide
  modified_base (20)..(21): 2'-methoxy-nucleotide
ggaaggagccacaccccucuu

SEQ ID NO: 2889 - RNA, 21 nt, Artificial Sequence
  Description of Artificial Sequence: Synthetic oligonucleotide
  modified_base (20)..(21): 2'-methoxy-nucleotide
gggaaggagccacaccccuuu

SEQ ID NO: 2890 - RNA, 21 nt, Artificial Sequence
  Description of Artificial Sequence: Synthetic oligonucleotide
  modified_base (20)..(21): 2'-methoxy-nucleotide
ugggaaggagccacaccccuu

SEQ ID NO: 2891 - RNA, 21 nt, Artificial Sequence
  Description of Artificial Sequence: Synthetic oligonucleotide
  modified_base (20)..(21): 2'-methoxy-nucleotide
augggaaggagccacacccuu

SEQ ID NO: 2892 - RNA, 21 nt, Artificial Sequence
  Description of Artificial Sequence: Synthetic oligonucleotide
  modified_base (20)..(21): 2'-methoxy-nucleotide
gaugggaaggagccacaccuu

SEQ ID NO: 2893 - RNA, 21 nt, Artificial Sequence
  Description of Artificial Sequence: Synthetic oligonucleotide
  modified_base (20)..(21): 2'-methoxy-nucleotide
cgaugggaaggagccacacuu

SEQ ID NO: 2894 - RNA, 21 nt, Artificial Sequence
  Description of Artificial Sequence: Synthetic oligonucleotide
  modified_base (20)..(21): 2'-methoxy-nucleotide
gcgaugggaaggagccacauu

SEQ ID NO: 2895 - RNA, 21 nt, Artificial Sequence
  Description of Artificial Sequence: Synthetic oligonucleotide
  modified_base (20)..(21): 2'-methoxy-nucleotide
agcgaugggaaggagccacuu

SEQ ID NO: 2896 - RNA, 21 nt, Artificial Sequence
  Description of Artificial Sequence: Synthetic oligonucleotide
  modified_base (20)..(21): 2'-methoxy-nucleotide
cagcgaugggaaggagccauu

SEQ ID NO: 2897 - RNA, 21 nt, Artificial Sequence
  Description of Artificial Sequence: Synthetic oligonucleotide
  modified_base (20)..(21): 2'-methoxy-nucleotide
acagcgaugggaaggagccuu

SEQ ID NO: 2898 - RNA, 21 nt, Artificial Sequence
  Description of Artificial Sequence: Synthetic oligonucleotide
  modified_base (20)..(21): 2'-methoxy-nucleotide
gacagcgaugggaaggagcuu

SEQ ID NO: 2899 - RNA, 21 nt, Artificial Sequence
  Description of Artificial Sequence: Synthetic oligonucleotide
  modified_base (20)..(21): 2'-methoxy-nucleotide
ugacagcgaugggaaggaguu

SEQ ID NO: 2900 - RNA, 21 nt, Artificial Sequence
  Description of Artificial Sequence: Synthetic oligonucleotide
  modified_base (20)..(21): 2'-methoxy-nucleotide
gugacagcgaugggaaggauu

SEQ ID NO: 2901 - RNA, 21 nt, Artificial Sequence
  Description of Artificial Sequence: Synthetic oligonucleotide
  modified_base (20)..(21): 2'-methoxy-nucleotide
ugugacagcgaugggaagguu

SEQ ID NO: 2902 - RNA, 21 nt, Artificial Sequence
  Description of Artificial Sequence: Synthetic oligonucleotide
  modified_base (20)..(21): 2'-methoxy-nucleotide
cugugacagcgaugggaaguu

SEQ ID NO: 2903 - RNA, 21 nt, Artificial Sequence
  Description of Artificial Sequence: Synthetic oligonucleotide
  modified_base (20)..(21): 2'-methoxy-nucleotide
ccugugacagcgaugggaauu

SEQ ID NO: 2904 - RNA, 21 nt, Artificial Sequence
  Description of Artificial Sequence: Synthetic oligonucleotide
  modified_base (20)..(21): 2'-methoxy-nucleotide
gccugugacagcgaugggauu

SEQ ID NO: 2905 - RNA, 21 nt, Artificial Sequence
  Description of Artificial Sequence: Synthetic oligonucleotide
  modified_base (20)..(21): 2'-methoxy-nucleotide
cgccugugacagcgauggguu

SEQ ID NO: 2906 - RNA, 21 nt, Artificial Sequence
  Description of Artificial Sequence: Synthetic oligonucleotide
  modified_base (20)..(21): 2'-methoxy-nucleotide
ccgccugugacagcgaugguu

SEQ ID NO: 2907 - RNA, 21 nt, Artificial Sequence
  Description of Artificial Sequence: Synthetic oligonucleotide
  modified_base (20)..(21): 2'-methoxy-nucleotide
accgccugugacagcgauguu

SEQ ID NO: 2908 - RNA, 21 nt, Artificial Sequence
  Description of Artificial Sequence: Synthetic oligonucleotide
  modified_base (20)..(21): 2'-methoxy-nucleotide
aaccgccugugacagcgauuu

SEQ ID NO: 2909 - RNA, 21 nt, Artificial Sequence
  Description of Artificial Sequence: Synthetic oligonucleotide
  modified_base (20)..(21): 2'-methoxy-nucleotide
uaaccgccugugacagcgauu

SEQ ID NO: 2910 - RNA, 21 nt, Artificial Sequence
  Description of Artificial Sequence: Synthetic oligonucleotide
  modified_base (20)..(21): 2'-methoxy-nucleotide
auaaccgccugugacagcguu

SEQ ID NO: 2911 - RNA, 21 nt, Artificial Sequence
  Description of Artificial Sequence: Synthetic oligonucleotide
  modified_base (20)..(21): 2'-methoxy-nucleotide
cauaaccgccugugacagcuu

SEQ ID NO: 2912 - RNA, 21 nt, Artificial Sequence
  Description of Artificial Sequence: Synthetic oligonucleotide
  modified_base (20)..(21): 2'-methoxy-nucleotide
ucauaaccgccugugacaguu

SEQ ID NO: 2913 - RNA, 21 nt, Artificial Sequence
  Description of Artificial Sequence: Synthetic oligonucleotide
  modified_base (20)..(21): 2'-methoxy-nucleotide
uucauaaccgccugugacauu

SEQ ID NO: 2914 - RNA, 21 nt, Artificial Sequence
  Description of Artificial Sequence: Synthetic oligonucleotide
  modified_base (20)..(21): 2'-methoxy-nucleotide
uuucauaaccgccugugacuu

SEQ ID NO: 2915 - RNA, 21 nt, Artificial Sequence
  Description of Artificial Sequence: Synthetic oligonucleotide
  modified_base (20)..(21): 2'-methoxy-nucleotide
auuucauaaccgccugugauu

SEQ ID NO: 2916 - RNA, 21 nt, Artificial Sequence
  Description of Artificial Sequence: Synthetic oligonucleotide
  modified_base (20)..(21): 2'-methoxy-nucleotide
aauuucauaaccgccuguguu

SEQ ID NO: 2917 - RNA, 21 nt, Artificial Sequence
  Description of Artificial Sequence: Synthetic oligonucleotide
  modified_base (20)..(21): 2'-methoxy-nucleotide
gaauuucauaaccgccuguuu

SEQ ID NO: 2918 - RNA, 21 nt, Artificial Sequence
  Description of Artificial Sequence: Synthetic oligonucleotide
  modified_base (20)..(21): 2'-methoxy-nucleotide
ugaauuucauaaccgccuguu

SEQ ID NO: 2919 - RNA, 21 nt, Artificial Sequence
  Description of Artificial Sequence: Synthetic oligonucleotide
  modified_base (20)..(21): 2'-methoxy-nucleotide
gugaauuucauaaccgccuuu

SEQ ID NO: 2920 - RNA, 21 nt, Artificial Sequence
  Description of Artificial Sequence: Synthetic oligonucleotide
  modified_base (20)..(21): 2'-methoxy-nucleotide
ggugaauuucauaaccgccuu

SEQ ID NO: 2921 - RNA, 21 nt, Artificial Sequence
  Description of Artificial Sequence: Synthetic oligonucleotide
  modified_base (20)..(21): 2'-methoxy-nucleotide
gggugaauuucauaaccgcuu

SEQ ID NO: 2922 - RNA, 21 nt, Artificial Sequence
  Description of Artificial Sequence: Synthetic oligonucleotide
  modified_base (20)..(21): 2'-methoxy-nucleotide
ggggugaauuucauaaccguu

SEQ ID NO: 2923 - RNA, 21 nt, Artificial Sequence
  Description of Artificial Sequence: Synthetic oligonucleotide
  modified_base (20)..(21): 2'-methoxy-nucleotide
gggggugaauuucauaaccuu

SEQ ID NO: 2924 - RNA, 21 nt, Artificial Sequence
  Description of Artificial Sequence: Synthetic oligonucleotide
  modified_base (20)..(21): 2'-methoxy-nucleotide
agggggugaauuucauaacuu

SEQ ID NO: 2925 - RNA, 21 nt, Artificial Sequence
  Description of Artificial Sequence: Synthetic oligonucleotide
  modified_base (20)..(21): 2'-methoxy-nucleotide
aagggggugaauuucauaauu

SEQ ID NO: 2926 - RNA, 21 nt, Artificial Sequence
  Description of Artificial Sequence: Synthetic oligonucleotide
  modified_base (20)..(21): 2'-methoxy-nucleotide
aaagggggugaauuucauauu

SEQ ID NO: 2927 - RNA, 21 nt, Artificial Sequence
  Description of Artificial Sequence: Synthetic oligonucleotide
  modified_base (20)..(21): 2'-methoxy-nucleotide
gaaagggggugaauuucauuu

SEQ ID NO: 2928 - RNA, 21 nt, Artificial Sequence
  Description of Artificial Sequence: Synthetic oligonucleotide
  modified_base (20)..(21): 2'-methoxy-nucleotide
ggaaagggggugaauuucauu

SEQ ID NO: 2929 - RNA, 21 nt, Artificial Sequence
  Description of Artificial Sequence: Synthetic oligonucleotide
  modified_base (20)..(21): 2'-methoxy-nucleotide
aggaaagggggugaauuucuu

SEQ ID NO: 2930 - RNA, 21 nt, Artificial Sequence
  Description of Artificial Sequence: Synthetic oligonucleotide
  modified_base (20)..(21): 2'-methoxy-nucleotide
caggaaagggggugaauuuuu

SEQ ID NO: 2931 - RNA, 21 nt, Artificial Sequence
  Description of Artificial Sequence: Synthetic oligonucleotide
  modified_base (20)..(21): 2'-methoxy-nucleotide
ccaggaaagggggugaauuuu

SEQ ID NO: 2932 - RNA, 21 nt, Artificial Sequence
  Description of Artificial Sequence: Synthetic oligonucleotide
  modified_base (20)..(21): 2'-methoxy-nucleotide
uccaggaaagggggugaauuu

SEQ ID NO: 2933 - RNA, 21 nt, Artificial Sequence
  Description of Artificial Sequence: Synthetic oligonucleotide
  modified_base (20)..(21): 2'-methoxy-nucleotide
guccaggaaagggggugaauu

SEQ ID NO: 2934 - RNA, 21 nt, Artificial Sequence
  Description of Artificial Sequence: Synthetic oligonucleotide
  modified_base (20)..(21): 2'-methoxy-nucleotide
uguccaggaaagggggugauu

SEQ ID NO: 2935 - RNA, 21 nt, Artificial Sequence
  Description of Artificial Sequence: Synthetic oligonucleotide
  modified_base (20)..(21): 2'-methoxy-nucleotide
guguccaggaaaggggguguu

SEQ ID NO: 2936 - RNA, 21 nt, Artificial Sequence
  Description of Artificial Sequence: Synthetic oligonucleotide
  modified_base (20)..(21): 2'-methoxy-nucleotide
aguguccaggaaaggggguuu

SEQ ID NO: 2937 - RNA, 21 nt, Artificial Sequence
  Description of Artificial Sequence: Synthetic oligonucleotide
  modified_base (20)..(21): 2'-methoxy-nucleotide
gaguguccaggaaaggggguu

SEQ ID NO: 2938 - RNA, 21 nt, Artificial Sequence
  Description of Artificial Sequence: Synthetic oligonucleotide
  modified_base (20)..(21): 2'-methoxy-nucleotide
ugaguguccaggaaagggguu

SEQ ID NO: 2939 - RNA, 21 nt, Artificial Sequence
  Description of Artificial Sequence: Synthetic oligonucleotide
  modified_base (20)..(21): 2'-methoxy-nucleotide
cugaguguccaggaaaggguu

SEQ ID NO: 2940 - RNA, 21 nt, Artificial Sequence
  Description of Artificial Sequence: Synthetic oligonucleotide
  modified_base (20)..(21): 2'-methoxy-nucleotide
ucugaguguccaggaaagguu

SEQ ID NO: 2941 - RNA, 21 nt, Artificial Sequence
  Description of Artificial Sequence: Synthetic oligonucleotide
  modified_base (20)..(21): 2'-methoxy-nucleotide
gucugaguguccaggaaaguu

SEQ ID NO: 2942 - RNA, 21 nt, Artificial Sequence
  Description of Artificial Sequence: Synthetic oligonucleotide
  modified_base (20)..(21): 2'-methoxy-nucleotide
ggucugaguguccaggaaauu

SEQ ID NO: 2943 - RNA, 21 nt, Artificial Sequence
  Description of Artificial Sequence: Synthetic oligonucleotide
  modified_base (20)..(21): 2'-methoxy-nucleotide
aggucugaguguccaggaauu

SEQ ID NO: 2944 - RNA, 21 nt, Artificial Sequence
  Description of Artificial Sequence: Synthetic oligonucleotide
  modified_base (20)..(21): 2'-methoxy-nucleotide
caggucugaguguccaggauu

SEQ ID NO: 2945 - RNA, 21 nt, Artificial Sequence
  Description of Artificial Sequence: Synthetic oligonucleotide
  modified_base (20)..(21): 2'-methoxy-nucleotide
ucaggucugaguguccagguu

SEQ ID NO: 2946 - RNA, 21 nt, Artificial Sequence
  Description of Artificial Sequence: Synthetic oligonucleotide
  modified_base (20)..(21): 2'-methoxy-nucleotide
uucaggucugaguguccaguu

SEQ ID NO: 2947 - RNA, 21 nt, Artificial Sequence
  Description of Artificial Sequence: Synthetic oligonucleotide
  modified_base (20)..(21): 2'-methoxy-nucleotide
auucaggucugaguguccauu

SEQ ID NO: 2948 - RNA, 21 nt, Artificial Sequence
  Description of Artificial Sequence: Synthetic oligonucleotide
  modified_base (20)..(21): 2'-methoxy-nucleotide
aauucaggucugaguguccuu

SEQ ID NO: 2949 - RNA, 21 nt, Artificial Sequence
  Description of Artificial Sequence: Synthetic oligonucleotide
  modified_base (20)..(21): 2'-methoxy-nucleotide
gaauucaggucugagugucuu

SEQ ID NO: 2950 - RNA, 21 nt, Artificial Sequence
  Description of Artificial Sequence: Synthetic oligonucleotide
  modified_base (20)..(21): 2'-methoxy-nucleotide
agaauucaggucugaguguuu

SEQ ID NO: 2951 - RNA, 21 nt, Artificial Sequence
  Description of Artificial Sequence: Synthetic oligonucleotide
  modified_base (20)..(21): 2'-methoxy-nucleotide
aagaauucaggucugaguguu

SEQ ID NO: 2952 - RNA, 21 nt, Artificial Sequence
  Description of Artificial Sequence: Synthetic oligonucleotide
  modified_base (20)..(21): 2'-methoxy-nucleotide
aaagaauucaggucugaguuu

SEQ ID NO: 2953 - RNA, 21 nt, Artificial Sequence
  Description of Artificial Sequence: Synthetic oligonucleotide
  modified_base (20)..(21): 2'-methoxy-nucleotide
aaaagaauucaggucugaguu

SEQ ID NO: 2954 - RNA, 21 nt, Artificial Sequence
  Description of Artificial Sequence: Synthetic oligonucleotide
  modified_base (20)..(21): 2'-methoxy-nucleotide
aaaaagaauucaggucugauu

SEQ ID NO: 2955 - RNA, 21 nt, Artificial Sequence
  Description of Artificial Sequence: Synthetic oligonucleotide
  modified_base (20)..(21): 2'-methoxy-nucleotide
gaaaaagaauucaggucuguu

SEQ ID NO: 2956 - RNA, 21 nt, Artificial Sequence
  Description of Artificial Sequence: Synthetic oligonucleotide
  modified_base (20)..(21): 2'-methoxy-nucleotide
ugaaaaagaauucaggucuuu

SEQ ID NO: 2957 - RNA, 21 nt, Artificial Sequence
  Description of Artificial Sequence: Synthetic oligonucleotide
  modified_base (20)..(21): 2'-methoxy-nucleotide
augaaaaagaauucaggucuu

SEQ ID NO: 2958 - RNA, 21 nt, Artificial Sequence
  Description of Artificial Sequence: Synthetic oligonucleotide
  modified_base (20)..(21): 2'-methoxy-nucleotide
aaugaaaaagaauucagguuu

SEQ ID NO: 2959 - RNA, 21 nt, Artificial Sequence
  Description of Artificial Sequence: Synthetic oligonucleotide
  modified_base (20)..(21): 2'-methoxy-nucleotide
aaaugaaaaagaauucagguu

SEQ ID NO: 2960 - RNA, 21 nt, Artificial Sequence
  Description of Artificial Sequence: Synthetic oligonucleotide
  modified_base (20)..(21): 2'-methoxy-nucleotide
caaaugaaaaagaauucaguu

SEQ ID NO: 2961 - RNA, 21 nt, Artificial Sequence
  Description of Artificial Sequence: Synthetic oligonucleotide
  modified_base (20)..(21): 2'-methoxy-nucleotide
ucaaaugaaaaagaauucauu

SEQ ID NO: 2962 - RNA, 21 nt, Artificial Sequence
  Description of Artificial Sequence: Synthetic oligonucleotide
  modified_base (20)..(21): 2'-methoxy-nucleotide
cucaaaugaaaaagaauucuu

SEQ ID NO: 2963 - RNA, 21 nt, Artificial Sequence
  Description of Artificial Sequence: Synthetic oligonucleotide
  modified_base (20)..(21): 2'-methoxy-nucleotide
ucucaaaugaaaaagaauuuu

SEQ ID NO: 2964 - RNA, 21 nt, Artificial Sequence
  Description of Artificial Sequence: Synthetic oligonucleotide
  modified_base (20)..(21): 2'-methoxy-nucleotide
uucucaaaugaaaaagaauuu

SEQ ID NO: 2965 - RNA, 21 nt, Artificial Sequence
  Description of Artificial Sequence: Synthetic oligonucleotide
  modified_base (20)..(21): 2'-methoxy-nucleotide
cuucucaaaugaaaaagaauu

SEQ ID NO: 2966 - RNA, 21 nt, Artificial Sequence
  Description of Artificial Sequence: Synthetic oligonucleotide
  modified_base (20)..(21): 2'-methoxy-nucleotide
acuucucaaaugaaaaagauu

SEQ ID NO: 2967 - RNA, 21 nt, Artificial Sequence
  Description of Artificial Sequence: Synthetic oligonucleotide
  modified_base (20)..(21): 2'-methoxy-nucleotide
uacuucucaaaugaaaaaguu

SEQ ID NO: 2968 - RNA, 21 nt, Artificial Sequence
  Description of Artificial Sequence: Synthetic oligonucleotide
  modified_base (20)..(21): 2'-methoxy-nucleotide
uuacuucucaaaugaaaaauu

SEQ ID NO: 2969 - RNA, 21 nt, Artificial Sequence
  Description of Artificial Sequence: Synthetic oligonucleotide
  modified_base (20)..(21): 2'-methoxy-nucleotide
uuuacuucucaaaugaaaauu

SEQ ID NO: 2970 - RNA, 21 nt, Artificial Sequence
  Description of Artificial Sequence: Synthetic oligonucleotide
  modified_base (20)..(21): 2'-methoxy-nucleotide
guuuacuucucaaaugaaauu

SEQ ID NO: 2971 - RNA, 21 nt, Artificial Sequence
  Description of Artificial Sequence: Synthetic oligonucleotide
  modified_base (20)..(21): 2'-methoxy-nucleotide
uguuuacuucucaaaugaauu

SEQ ID NO: 2972 - RNA, 21 nt, Artificial Sequence
  Description of Artificial Sequence: Synthetic oligonucleotide
  modified_base (20)..(21): 2'-methoxy-nucleotide
cuguuuacuucucaaaugauu

SEQ ID NO: 2973 - RNA, 21 nt, Artificial Sequence
  Description of Artificial Sequence: Synthetic oligonucleotide
  modified_base (20)..(21): 2'-methoxy-nucleotide
ucuguuuacuucucaaauguu

SEQ ID NO: 2974 - RNA, 21 nt, Artificial Sequence
  Description of Artificial Sequence: Synthetic oligonucleotide
  modified_base (20)..(21): 2'-methoxy-nucleotide
aucuguuuacuucucaaauuu

SEQ ID NO: 2975 - RNA, 21 nt, Artificial Sequence
  Description of Artificial Sequence: Synthetic oligonucleotide
  modified_base (20)..(21): 2'-methoxy-nucleotide
caucuguuuacuucucaaauu

SEQ ID NO: 2976 - RNA, 21 nt, Artificial Sequence
  Description of Artificial Sequence: Synthetic oligonucleotide
  modified_base (20)..(21): 2'-methoxy-nucleotide
ccaucuguuuacuucucaauu

SEQ ID NO: 2977 - RNA, 21 nt, Artificial Sequence
  Description of Artificial Sequence: Synthetic oligonucleotide
  modified_base (20)..(21): 2'-methoxy-nucleotide
gccaucuguuuacuucucauu

SEQ ID NO: 2978 - RNA, 21 nt, Artificial Sequence
  Description of Artificial Sequence: Synthetic oligonucleotide
  modified_base (20)..(21): 2'-methoxy-nucleotide
ugccaucuguuuacuucucuu

SEQ ID NO: 2979 - RNA, 21 nt, Artificial Sequence
  Description of Artificial Sequence: Synthetic oligonucleotide
  modified_base (20)..(21): 2'-methoxy-nucleotide
gugccaucuguuuacuucuuu

SEQ ID NO: 2980 - RNA, 21 nt, Artificial Sequence
  Description of Artificial Sequence: Synthetic oligonucleotide
  modified_base (20)..(21): 2'-methoxy-nucleotide
agugccaucuguuuacuucuu

SEQ ID NO: 2981 - RNA, 21 nt, Artificial Sequence
  Description of Artificial Sequence: Synthetic oligonucleotide
  modified_base (20)..(21): 2'-methoxy-nucleotide
aagugccaucuguuuacuuuu

SEQ ID NO: 2982 - RNA, 21 nt, Artificial Sequence
  Description of Artificial Sequence: Synthetic oligonucleotide
  modified_base (20)..(21): 2'-methoxy-nucleotide
aaagugccaucuguuuacuuu

SEQ ID NO: 2983 - RNA, 21 nt, Artificial Sequence
  Description of Artificial Sequence: Synthetic oligonucleotide
  modified_base (20)..(21): 2'-methoxy-nucleotide
caaagugccaucuguuuacuu

SEQ ID NO: 2984 - RNA, 21 nt, Artificial Sequence
  Description of Artificial Sequence: Synthetic oligonucleotide
  modified_base (20)..(21): 2'-methoxy-nucleotide
ucaaagugccaucuguuuauu

SEQ ID NO: 2985 - RNA, 21 nt, Artificial Sequence
  Description of Artificial Sequence: Synthetic oligonucleotide
  modified_base (20)..(21): 2'-methoxy-nucleotide
uucaaagugccaucuguuuuu

SEQ ID NO: 2986 - RNA, 21 nt, Artificial Sequence
  Description of Artificial Sequence: Synthetic oligonucleotide
  modified_base (20)..(21): 2'-methoxy-nucleotide
cuucaaagugccaucuguuuu

SEQ ID NO: 2987 - RNA, 21 nt, Artificial Sequence
  Description of Artificial Sequence: Synthetic oligonucleotide
  modified_base (20)..(21): 2'-methoxy-nucleotide
ccuucaaagugccaucuguuu

SEQ ID NO: 2988 - RNA, 21 nt, Artificial Sequence
  Description of Artificial Sequence: Synthetic oligonucleotide
  modified_base (20)..(21): 2'-methoxy-nucleotide
cccuucaaagugccaucuguu

SEQ ID NO: 2989 - RNA, 21 nt, Artificial Sequence
  Description of Artificial Sequence: Synthetic oligonucleotide
  modified_base (20)..(21): 2'-methoxy-nucleotide
ccccuucaaagugccaucuuu

SEQ ID NO: 2990 - RNA, 21 nt, Artificial Sequence
  Description of Artificial Sequence: Synthetic oligonucleotide
  modified_base (20)..(21): 2'-methoxy-nucleotide
gccccuucaaagugccaucuu

SEQ ID NO: 2991 - RNA, 21 nt, Artificial Sequence
  Description of Artificial Sequence: Synthetic oligonucleotide
  modified_base (20)..(21): 2'-methoxy-nucleotide
ggccccuucaaagugccauuu

SEQ ID NO: 2992 - RNA, 21 nt, Artificial Sequence
  Description of Artificial Sequence: Synthetic oligonucleotide
  modified_base (20)..(21): 2'-methoxy-nucleotide
aggccccuucaaagugccauu

SEQ ID NO: 2993 - RNA, 21 nt, Artificial Sequence
  Description of Artificial Sequence: Synthetic oligonucleotide
  modified_base (20)..(21): 2'-methoxy-nucleotide
gaggccccuucaaagugccuu

SEQ ID NO: 2994 - RNA, 21 nt, Artificial Sequence
  Description of Artificial Sequence: Synthetic oligonucleotide
  modified_base (20)..(21): 2'-methoxy-nucleotide
ugaggccccuucaaagugcuu

SEQ ID NO: 2995 - RNA, 21 nt, Artificial Sequence
  Description of Artificial Sequence: Synthetic oligonucleotide
  modified_base (20)..(21): 2'-methoxy-nucleotide
gugaggccccuucaaaguguu

SEQ ID NO: 2996 - RNA, 21 nt, Artificial Sequence
  Description of Artificial Sequence: Synthetic oligonucleotide
  modified_base (20)..(21): 2'-methoxy-nucleotide
ggugaggccccuucaaaguuu

SEQ ID NO: 2997 - RNA, 21 nt, Artificial Sequence
  Description of Artificial Sequence: Synthetic oligonucleotide
  modified_base (20)..(21): 2'-methoxy-nucleotide
cggugaggccccuucaaaguu

SEQ ID NO: 2998 - RNA, 21 nt, Artificial Sequence
  Description of Artificial Sequence: Synthetic oligonucleotide
  modified_base (20)..(21): 2'-methoxy-nucleotide
ucggugaggccccuucaaauu

SEQ ID NO: 2999 - RNA, 21 nt, Artificial Sequence
  Description of Artificial Sequence: Synthetic oligonucleotide
  modified_base (20)..(21): 2'-methoxy-nucleotide
cucggugaggccccuucaauu

SEQ ID NO: 3000 - RNA, 21 nt, Artificial Sequence
  Description of Artificial Sequence: Synthetic oligonucleotide
  modified_base (20)..(21): 2'-methoxy-nucleotide
acucggugaggccccuucauu

SEQ ID NO: 3001 - RNA, 21 nt, Artificial Sequence
  Description of Artificial Sequence: Synthetic oligonucleotide
  modified_base (20)..(21): 2'-methoxy-nucleotide
cacucggugaggccccuucuu

SEQ ID NO: 3002 - RNA, 21 nt, Artificial Sequence
  Description of Artificial Sequence: Synthetic oligonucleotide
  modified_base (20)..(21): 2'-methoxy-nucleotide
ccacucggugaggccccuuuu

SEQ ID NO: 3003 - RNA, 21 nt, Artificial Sequence
  Description of Artificial Sequence: Synthetic oligonucleotide
  modified_base (20)..(21): 2'-methoxy-nucleotide
cccacucggugaggccccuuu

SEQ ID NO: 3004 - RNA, 21 nt, Artificial Sequence
  Description of Artificial Sequence: Synthetic oligonucleotide
  modified_base (20)..(21): 2'-methoxy-nucleotide
ccccacucggugaggccccuu

SEQ ID NO: 3005 - RNA, 21 nt, Artificial Sequence
  Description of Artificial Sequence: Synthetic oligonucleotide
  modified_base (20)..(21): 2'-methoxy-nucleotide
cccccacucggugaggcccuu

SEQ ID NO: 3006 - RNA, 21 nt, Artificial Sequence
  Description of Artificial Sequence: Synthetic oligonucleotide
  modified_base (20)..(21): 2'-methoxy-nucleotide
gcccccacucggugaggccuu

SEQ ID NO: 3007 - RNA, 21 nt, Artificial Sequence
  Description of Artificial Sequence: Synthetic oligonucleotide
  modified_base (20)..(21): 2'-methoxy-nucleotide
ugcccccacucggugaggcuu

SEQ ID NO: 3008 - RNA, 21 nt, Artificial Sequence
  Description of Artificial Sequence: Synthetic oligonucleotide
  modified_base (20)..(21): 2'-methoxy-nucleotide
augcccccacucggugagguu

SEQ ID NO: 3009 - RNA, 21 nt, Artificial Sequence
  Description of Artificial Sequence: Synthetic oligonucleotide
  modified_base (20)..(21): 2'-methoxy-nucleotide
gaugcccccacucggugaguu

SEQ ID NO: 3010 - RNA, 21 nt, Artificial Sequence
  Description of Artificial Sequence: Synthetic oligonucleotide
  modified_base (20)..(21): 2'-methoxy-nucleotide
ugaugcccccacucggugauu

SEQ ID NO: 3011 - RNA, 21 nt, Artificial Sequence
  Description of Artificial Sequence: Synthetic oligonucleotide
  modified_base (20)..(21): 2'-methoxy-nucleotide
augaugcccccacucgguguu

SEQ ID NO: 3012 - RNA, 21 nt, Artificial Sequence
  Description of Artificial Sequence: Synthetic oligonucleotide
  modified_base (20)..(21): 2'-methoxy-nucleotide
gaugaugcccccacucgguuu

SEQ ID NO: 3013 - RNA, 21 nt, Artificial Sequence
  Description of Artificial Sequence: Synthetic oligonucleotide
  modified_base (20)..(21): 2'-methoxy-nucleotide
ugaugaugcccccacucgguu

SEQ ID NO: 3014 - RNA, 21 nt, Artificial Sequence
  Description of Artificial Sequence: Synthetic oligonucleotide
  modified_base (20)..(21): 2'-methoxy-nucleotide
uugaugaugcccccacucguu

SEQ ID NO: 3015 - RNA, 21 nt, Artificial Sequence
  Description of Artificial Sequence: Synthetic oligonucleotide
  modified_base (20)..(21): 2'-methoxy-nucleotide
uuugaugaugcccccacucuu

SEQ ID NO: 3016 - RNA, 21 nt, Artificial Sequence
  Description of Artificial Sequence: Synthetic oligonucleotide
  modified_base (20)..(21): 2'-methoxy-nucleotide
uuuugaugaugcccccacuuu

SEQ ID NO: 3017 - RNA, 21 nt, Artificial Sequence
  Description of Artificial Sequence: Synthetic oligonucleotide
  modified_base (20)..(21): 2'-methoxy-nucleotide
uuuuugaugaugcccccacuu

SEQ ID NO: 3018 - RNA, 21 nt, Artificial Sequence
  Description of Artificial Sequence: Synthetic oligonucleotide
  modified_base (20)..(21): 2'-methoxy-nucleotide
guuuuugaugaugcccccauu

SEQ ID NO: 3019 - RNA, 21 nt, Artificial Sequence
  Description of Artificial Sequence: Synthetic oligonucleotide
  modified_base (20)..(21): 2'-methoxy-nucleotide
aguuuuugaugaugcccccuu

SEQ ID NO: 3020 - RNA, 21 nt, Artificial Sequence
  Description of Artificial Sequence: Synthetic oligonucleotide
  modified_base (20)..(21): 2'-methoxy-nucleotide
aaguuuuugaugaugccccuu

SEQ ID NO: 3021 - RNA, 21 nt, Artificial Sequence
  Description of Artificial Sequence: Synthetic oligonucleotide
  modified_base (20)..(21): 2'-methoxy-nucleotide
aaaguuuuugaugaugcccuu

SEQ ID NO: 3022 - RNA, 21 nt, Artificial Sequence
  Description of Artificial Sequence: Synthetic oligonucleotide
  modified_base (20)..(21): 2'-methoxy-nucleotide
caaaguuuuugaugaugccuu

SEQ ID NO: 3023 - RNA, 21 nt, Artificial Sequence
  Description of Artificial Sequence: Synthetic oligonucleotide
  modified_base (20)..(21): 2'-methoxy-nucleotide
ccaaaguuuuugaugaugcuu

SEQ ID NO: 3024 - RNA, 21 nt, Artificial Sequence
  Description of Artificial Sequence: Synthetic oligonucleotide
  modified_base (20)..(21): 2'-methoxy-nucleotide
uccaaaguuuuugaugauguu

SEQ ID NO: 3025 - RNA, 21 nt, Artificial Sequence
  Description of Artificial Sequence: Synthetic oligonucleotide
  modified_base (20)..(21): 2'-methoxy-nucleotide
cuccaaaguuuuugaugauuu

SEQ ID NO: 3026 - RNA, 21 nt, Artificial Sequence
  Description of Artificial Sequence: Synthetic oligonucleotide
  modified_base (20)..(21): 2'-methoxy-nucleotide
acuccaaaguuuuugaugauu

SEQ ID NO: 3027 - RNA, 21 nt, Artificial Sequence
  Description of Artificial Sequence: Synthetic oligonucleotide
  modified_base (20)..(21): 2'-methoxy-nucleotide
gacuccaaaguuuuugauguu

SEQ ID NO: 3028 - RNA, 21 nt, Artificial Sequence
  Description of Artificial Sequence: Synthetic oligonucleotide
  modified_base (20)..(21): 2'-methoxy-nucleotide
ggacuccaaaguuuuugauuu

SEQ ID NO: 3029 - RNA, 21 nt, Artificial Sequence
  Description of Artificial Sequence: Synthetic oligonucleotide
  modified_base (20)..(21): 2'-methoxy-nucleotide
gggacuccaaaguuuuugauu

SEQ ID NO: 3030 - RNA, 21 nt, Artificial Sequence
  Description of Artificial Sequence: Synthetic oligonucleotide
  modified_base (20)..(21): 2'-methoxy-nucleotide
ggggacuccaaaguuuuuguu

SEQ ID NO: 3031 - RNA, 21 nt, Artificial Sequence
  Description of Artificial Sequence: Synthetic oligonucleotide
  modified_base (20)..(21): 2'-methoxy-nucleotide
aggggacuccaaaguuuuuuu

SEQ ID NO: 3032 - RNA, 21 nt, Artificial Sequence
  Description of Artificial Sequence: Synthetic oligonucleotide
  modified_base (20)..(21): 2'-methoxy-nucleotide
gaggggacuccaaaguuuuuu

SEQ ID NO: 3033 - RNA, 21 nt, Artificial Sequence
  Description of Artificial Sequence: Synthetic oligonucleotide
  modified_base (20)..(21): 2'-methoxy-nucleotide
ugaggggacuccaaaguuuuu

SEQ ID NO: 3034 - RNA, 21 nt, Artificial Sequence
  Description of Artificial Sequence: Synthetic oligonucleotide
  modified_base (20)..(21): 2'-methoxy-nucleotide
gugaggggacuccaaaguuuu

SEQ ID NO: 3035 - RNA, 21 nt, Artificial Sequence
  Description of Artificial Sequence: Synthetic oligonucleotide
  modified_base (20)..(21): 2'-methoxy-nucleotide
ggugaggggacuccaaaguuu

SEQ ID NO: 3036 - RNA, 21 nt, Artificial Sequence
  Description of Artificial Sequence: Synthetic oligonucleotide
  modified_base (20)..(21): 2'-methoxy-nucleotide
aggugaggggacuccaaaguu

SEQ ID NO: 3037 - RNA, 21 nt, Artificial Sequence
  Description of Artificial Sequence: Synthetic oligonucleotide
  modified_base (20)..(21): 2'-methoxy-nucleotide
gaggugaggggacuccaaauu

SEQ ID NO: 3038 - RNA, 21 nt, Artificial Sequence
  Description of Artificial Sequence: Synthetic oligonucleotide
  modified_base (20)..(21): 2'-methoxy-nucleotide
ggaggugaggggacuccaauu

SEQ ID NO: 3039 - RNA, 21 nt, Artificial Sequence
  Description of Artificial Sequence: Synthetic oligonucleotide
  modified_base (20)..(21): 2'-methoxy-nucleotide
aggaggugaggggacuccauu

SEQ ID NO: 3040 - RNA, 21 nt, Artificial Sequence
  Description of Artificial Sequence: Synthetic oligonucleotide
  modified_base (20)..(21): 2'-methoxy-nucleotide
gaggaggugaggggacuccuu

SEQ ID NO: 3041 - RNA, 21 nt, Artificial Sequence
  Description of Artificial Sequence: Synthetic oligonucleotide
  modified_base (20)..(21): 2'-methoxy-nucleotide
agaggaggugaggggacucuu

SEQ ID NO: 3042 - RNA, 21 nt, Artificial Sequence
  Description of Artificial Sequence: Synthetic oligonucleotide
  modified_base (20)..(21): 2'-methoxy-nucleotide
uagaggaggugaggggacuuu

SEQ ID NO: 3043 - RNA, 21 nt, Artificial Sequence
  Description of Artificial Sequence: Synthetic oligonucleotide
  modified_base (20)..(21): 2'-methoxy-nucleotide
uuagaggaggugaggggacuu

SEQ ID NO: 3044 - RNA, 21 nt, Artificial Sequence
  Description of Artificial Sequence: Synthetic oligonucleotide
  modified_base (20)..(21): 2'-methoxy-nucleotide
cuuagaggaggugaggggauu

SEQ ID NO: 3045 - RNA, 21 nt, Artificial Sequence
  Description of Artificial Sequence: Synthetic oligonucleotide
  modified_base (20)..(21): 2'-methoxy-nucleotide
ccuuagaggaggugagggguu

SEQ ID NO: 3046 - RNA, 21 nt, Artificial Sequence
  Description of Artificial Sequence: Synthetic oligonucleotide
  modified_base (20)..(21): 2'-methoxy-nucleotide
accuuagaggaggugaggguu

SEQ ID NO: 3047 - RNA, 21 nt, Artificial Sequence
  Description of Artificial Sequence: Synthetic oligonucleotide
  modified_base (20)..(21): 2'-methoxy-nucleotide
aaccuuagaggaggugagguu

SEQ ID NO: 3048 - RNA, 21 nt, Artificial Sequence
  Description of Artificial Sequence: Synthetic oligonucleotide
  modified_base (20)..(21): 2'-methoxy-nucleotide
caaccuuagaggaggugaguu

SEQ ID NO: 3049 - RNA, 21 nt, Artificial Sequence
  Description of Artificial Sequence: Synthetic oligonucleotide
  modified_base (20)..(21): 2'-methoxy-nucleotide
ccaaccuuagaggaggugauu

SEQ ID NO: 3050 - RNA, 21 nt, Artificial Sequence
  Description of Artificial Sequence: Synthetic oligonucleotide
  modified_base (20)..(21): 2'-methoxy-nucleotide
cccaaccuuagaggagguguu

SEQ ID NO: 3051 - RNA, 21 nt, Artificial Sequence
  Description of Artificial Sequence: Synthetic oligonucleotide
  modified_base (20)..(21): 2'-methoxy-nucleotide
gcccaaccuuagaggagguuu

SEQ ID NO: 3052 - RNA, 21 nt, Artificial Sequence
  Description of Artificial Sequence: Synthetic oligonucleotide
  modified_base (20)..(21): 2'-methoxy-nucleotide
ugcccaaccuuagaggagguu

SEQ ID NO: 3053 - RNA, 21 nt, Artificial Sequence
  Description of Artificial Sequence: Synthetic oligonucleotide
  modified_base (20)..(21): 2'-methoxy-nucleotide
cugcccaaccuuagaggaguu

SEQ ID NO: 3054 - RNA, 21 nt, Artificial Sequence
  Description of Artificial Sequence: Synthetic oligonucleotide
  modified_base (20)..(21): 2'-methoxy-nucleotide
ccugcccaaccuuagaggauu

SEQ ID NO: 3055 - RNA, 21 nt, Artificial Sequence
  Description of Artificial Sequence: Synthetic oligonucleotide
  modified_base (20)..(21): 2'-methoxy-nucleotide
cccugcccaaccuuagagguu

SEQ ID NO: 3056 - RNA, 21 nt, Artificial Sequence
  Description of Artificial Sequence: Synthetic oligonucleotide
  modified_base (20)..(21): 2'-methoxy-nucleotide
acccugcccaaccuuagaguu

SEQ ID NO: 3057 - RNA, 21 nt, Artificial Sequence
  Description of Artificial Sequence: Synthetic oligonucleotide
  modified_base (20)..(21): 2'-methoxy-nucleotide
cacccugcccaaccuuagauu

SEQ ID NO: 3058 - RNA, 21 nt, Artificial Sequence
  Description of Artificial Sequence: Synthetic oligonucleotide
  modified_base (20)..(21): 2'-methoxy-nucleotide
ucacccugcccaaccuuaguu

SEQ ID NO: 3059 - RNA, 21 nt, Artificial Sequence
  Description of Artificial Sequence: Synthetic oligonucleotide
  modified_base (20)..(21): 2'-methoxy-nucleotide
gucacccugcccaaccuuauu

SEQ ID NO: 3060 - RNA, 21 nt, Artificial Sequence
  Description of Artificial Sequence: Synthetic oligonucleotide
  modified_base (20)..(21): 2'-methoxy-nucleotide
ggucacccugcccaaccuuuu

SEQ ID NO: 3061 - RNA, 21 nt, Artificial Sequence
  Description of Artificial Sequence: Synthetic oligonucleotide
  modified_base (20)..(21): 2'-methoxy-nucleotide
gggucacccugcccaaccuuu

SEQ ID NO: 3062 - RNA, 21 nt, Artificial Sequence
  Description of Artificial Sequence: Synthetic oligonucleotide
  modified_base (20)..(21): 2'-methoxy-nucleotide
agggucacccugcccaaccuu

SEQ ID NO: 3063 - RNA, 21 nt, Artificial Sequence
  Description of Artificial Sequence: Synthetic oligonucleotide
  modified_base (20)..(21): 2'-methoxy-nucleotide
cagggucacccugcccaacuu

SEQ ID NO: 3064 - RNA, 21 nt, Artificial Sequence
  Description of Artificial Sequence: Synthetic oligonucleotide
  modified_base (20)..(21): 2'-methoxy-nucleotide
ucagggucacccugcccaauu

SEQ ID NO: 3065 - RNA, 21 nt, Artificial Sequence
  Description of Artificial Sequence: Synthetic oligonucleotide
  modified_base (20)..(21): 2'-methoxy-nucleotide
uucagggucacccugcccauu

SEQ ID NO: 3066 - RNA, 21 nt, Artificial Sequence
  Description of Artificial Sequence: Synthetic oligonucleotide
  modified_base (20)..(21): 2'-methoxy-nucleotide
cuucagggucacccugcccuu

SEQ ID NO: 3067 - RNA, 21 nt, Artificial Sequence
  Description of Artificial Sequence: Synthetic oligonucleotide
  modified_base (20)..(21): 2'-methoxy-nucleotide
acuucagggucacccugccuu

SEQ ID NO: 3068 - RNA, 21 nt, Artificial Sequence
  Description of Artificial Sequence: Synthetic oligonucleotide
  modified_base (20)..(21): 2'-methoxy-nucleotide
cacuucagggucacccugcuu

SEQ ID NO: 3069 - RNA, 21 nt, Artificial Sequence
  Description of Artificial Sequence: Synthetic oligonucleotide
  modified_base (20)..(21): 2'-methoxy-nucleotide
ucacuucagggucacccuguu

SEQ ID NO: 3070 - RNA, 21 nt, Artificial Sequence
  Description of Artificial Sequence: Synthetic oligonucleotide
  modified_base (20)..(21): 2'-methoxy-nucleotide
cucacuucagggucacccuuu

SEQ ID NO: 3071 - RNA, 21 nt, Artificial Sequence
  Description of Artificial Sequence: Synthetic oligonucleotide
  modified_base (20)..(21): 2'-methoxy-nucleotide
gcucacuucagggucacccuu

SEQ ID NO: 3072 - RNA, 21 nt, Artificial Sequence
  Description of Artificial Sequence: Synthetic oligonucleotide
  modified_base (20)..(21): 2'-methoxy-nucleotide
ugcucacuucagggucaccuu

SEQ ID NO: 3073 - RNA, 21 nt, Artificial Sequence
  Description of Artificial Sequence: Synthetic oligonucleotide
  modified_base (20)..(21): 2'-methoxy-nucleotide
gugcucacuucagggucacuu

SEQ ID NO: 3074 - RNA, 21 nt, Artificial Sequence
  Description of Artificial Sequence: Synthetic oligonucleotide
  modified_base (20)..(21): 2'-methoxy-nucleotide
ugugcucacuucagggucauu

SEQ ID NO: 3075 - RNA, 21 nt, Artificial Sequence
  Description of Artificial Sequence: Synthetic oligonucleotide
  modified_base (20)..(21): 2'-methoxy-nucleotide
cugugcucacuucagggucuu

SEQ ID NO: 3076 - RNA, 21 nt, Artificial Sequence
  Description of Artificial Sequence: Synthetic oligonucleotide
  modified_base (20)..(21): 2'-methoxy-nucleotide
gcugugcucacuucaggguuu

SEQ ID NO: 3077 - RNA, 21 nt, Artificial Sequence
  Description of Artificial Sequence: Synthetic oligonucleotide
  modified_base (20)..(21): 2'-methoxy-nucleotide
ggcugugcucacuucaggguu

SEQ ID NO: 3078 - RNA, 21 nt, Artificial Sequence
  Description of Artificial Sequence: Synthetic oligonucleotide
  modified_base (20)..(21): 2'-methoxy-nucleotide
aggcugugcucacuucagguu

SEQ ID NO: 3079 - RNA, 21 nt, Artificial Sequence
  Description of Artificial Sequence: Synthetic oligonucleotide
  modified_base (20)..(21): 2'-methoxy-nucleotide
uaggcugugcucacuucaguu

SEQ ID NO: 3080 - RNA, 21 nt, Artificial Sequence
  Description of Artificial Sequence: Synthetic oligonucleotide
  modified_base (20)..(21): 2'-methoxy-nucleotide
cuaggcugugcucacuucauu

SEQ ID NO: 3081 - RNA, 21 nt, Artificial Sequence
  Description of Artificial Sequence: Synthetic oligonucleotide
  modified_base (20)..(21): 2'-methoxy-nucleotide
ccuaggcugugcucacuucuu

SEQ ID NO: 3082 - RNA, 21 nt, Artificial Sequence
  Description of Artificial Sequence: Synthetic oligonucleotide
  modified_base (20)..(21): 2'-methoxy-nucleotide
cccuaggcugugcucacuuuu

SEQ ID NO: 3083 - RNA, 21 nt, Artificial Sequence
  Description of Artificial Sequence: Synthetic oligonucleotide
  modified_base (20)..(21): 2'-methoxy-nucleotide
gcccuaggcugugcucacuuu

SEQ ID NO: 3084 - RNA, 21 nt, Artificial Sequence
  Description of Artificial Sequence: Synthetic oligonucleotide
  modified_base (20)..(21): 2'-methoxy-nucleotide
agcccuaggcugugcucacuu

SEQ ID NO: 3085 - RNA, 21 nt, Artificial Sequence
  Description of Artificial Sequence: Synthetic oligonucleotide
  modified_base (20)..(21): 2'-methoxy-nucleotide
cagcccuaggcugugcucauu

SEQ ID NO: 3086 - RNA, 21 nt, Artificial Sequence
  Description of Artificial Sequence: Synthetic oligonucleotide
  modified_base (20)..(21): 2'-methoxy-nucleotide
ucagcccuaggcugugcucuu

SEQ ID NO: 3087 - RNA, 21 nt, Artificial Sequence
  Description of Artificial Sequence: Synthetic oligonucleotide
  modified_base (20)..(21): 2'-methoxy-nucleotide
cucagcccuaggcugugcuuu

SEQ ID NO: 3088 - RNA, 21 nt, Artificial Sequence
  Description of Artificial Sequence: Synthetic oligonucleotide
  modified_base (20)..(21): 2'-methoxy-nucleotide
gcucagcccuaggcugugcuu

SEQ ID NO: 3089 - RNA, 21 nt, Artificial Sequence
  Description of Artificial Sequence: Synthetic oligonucleotide
  modified_base (20)..(21): 2'-methoxy-nucleotide
agcucagcccuaggcuguguu

SEQ ID NO: 3090 - RNA, 21 nt, Artificial Sequence
  Description of Artificial Sequence: Synthetic oligonucleotide
  modified_base (20)..(21): 2'-methoxy-nucleotide
cagcucagcccuaggcuguuu

SEQ ID NO: 3091 - RNA, 21 nt, Artificial Sequence
  Description of Artificial Sequence: Synthetic oligonucleotide
  modified_base (20)..(21): 2'-methoxy-nucleotide
ccagcucagcccuaggcuguu

SEQ ID NO: 3092 - RNA, 21 nt, Artificial Sequence
  Description of Artificial Sequence: Synthetic oligonucleotide
  modified_base (20)..(21): 2'-methoxy-nucleotide
cccagcucagcccuaggcuuu

SEQ ID NO: 3093 - RNA, 21 nt, Artificial Sequence
  Description of Artificial Sequence: Synthetic oligonucleotide
  modified_base (20)..(21): 2'-methoxy-nucleotide
ccccagcucagcccuaggcuu

SEQ ID NO: 3094 - RNA, 21 nt, Artificial Sequence
  Description of Artificial Sequence: Synthetic oligonucleotide
  modified_base (20)..(21): 2'-methoxy-nucleotide
uccccagcucagcccuagguu

SEQ ID NO: 3095 - RNA, 21 nt, Artificial Sequence
  Description of Artificial Sequence: Synthetic oligonucleotide
  modified_base (20)..(21): 2'-methoxy-nucleotide
guccccagcucagcccuaguu

SEQ ID NO: 3096 - RNA, 21 nt, Artificial Sequence
  Description of Artificial Sequence: Synthetic oligonucleotide
  modified_base (20)..(21): 2'-methoxy-nucleotide
gguccccagcucagcccuauu

SEQ ID NO: 3097 - RNA, 21 nt, Artificial Sequence
  Description of Artificial Sequence: Synthetic oligonucleotide
  modified_base (20)..(21): 2'-methoxy-nucleotide
agguccccagcucagcccuuu

SEQ ID NO: 3098 - RNA, 21 nt, Artificial Sequence
  Description of Artificial Sequence: Synthetic oligonucleotide
  modified_base (20)..(21): 2'-methoxy-nucleotide
cagguccccagcucagcccuu

SEQ ID NO: 3099 - RNA, 21 nt, Artificial Sequence
  Description of Artificial Sequence: Synthetic oligonucleotide
  modified_base (20)..(21): 2'-methoxy-nucleotide
ccagguccccagcucagccuu

SEQ ID NO: 3100 - RNA, 21 nt, Artificial Sequence
  Description of Artificial Sequence: Synthetic oligonucleotide
  modified_base (20)..(21): 2'-methoxy-nucleotide
accagguccccagcucagcuu

SEQ ID NO: 3101 - RNA, 21 nt, Artificial Sequence
  Description of Artificial Sequence: Synthetic oligonucleotide
  modified_base (20)..(21): 2'-methoxy-nucleotide
uaccagguccccagcucaguu

SEQ ID NO: 3102 - RNA, 21 nt, Artificial Sequence
  Description of Artificial Sequence: Synthetic oligonucleotide
  modified_base (20)..(21): 2'-methoxy-nucleotide
guaccagguccccagcucauu

SEQ ID NO: 3103 - RNA, 21 nt, Artificial Sequence
  Description of Artificial Sequence: Synthetic oligonucleotide
  modified_base (20)..(21): 2'-methoxy-nucleotide
gguaccagguccccagcucuu

SEQ ID NO: 3104 - RNA, 21 nt, Artificial Sequence
  Description of Artificial Sequence: Synthetic oligonucleotide
  modified_base (20)..(21): 2'-methoxy-nucleotide
ggguaccagguccccagcuuu

SEQ ID NO: 3105 - RNA, 21 nt, Artificial Sequence
  Description of Artificial Sequence: Synthetic oligonucleotide
  modified_base (20)..(21): 2'-methoxy-nucleotide
aggguaccagguccccagcuu

SEQ ID NO: 3106 - RNA, 21 nt, Artificial Sequence
  Description of Artificial Sequence: Synthetic oligonucleotide
  modified_base (20)..(21): 2'-methoxy-nucleotide
gaggguaccagguccccaguu

SEQ ID NO: 3107 - RNA, 21 nt, Artificial Sequence
  Description of Artificial Sequence: Synthetic oligonucleotide
  modified_base (20)..(21): 2'-methoxy-nucleotide
ggaggguaccagguccccauu

SEQ ID NO: 3108 - RNA, 21 nt, Artificial Sequence
  Description of Artificial Sequence: Synthetic oligonucleotide
  modified_base (20)..(21): 2'-methoxy-nucleotide
aggaggguaccagguccccuu

SEQ ID NO: 3109 - RNA, 21 nt, Artificial Sequence
  Description of Artificial Sequence: Synthetic oligonucleotide
  modified_base (20)..(21): 2'-methoxy-nucleotide
caggaggguaccaggucccuu

SEQ ID NO: 3110 - RNA, 21 nt, Artificial Sequence
  Description of Artificial Sequence: Synthetic oligonucleotide
  modified_base (20)..(21): 2'-methoxy-nucleotide
ccaggaggguaccagguccuu

SEQ ID NO: 3111 - RNA, 21 nt, Artificial Sequence
  Description of Artificial Sequence: Synthetic oligonucleotide
  modified_base (20)..(21): 2'-methoxy-nucleotide
gccaggaggguaccaggucuu

SEQ ID NO: 3112 - RNA, 21 nt, Artificial Sequence
  Description of Artificial Sequence: Synthetic oligonucleotide
  modified_base (20)..(21): 2'-methoxy-nucleotide
agccaggaggguaccagguuu

SEQ ID NO: 3113 - RNA, 21 nt, Artificial Sequence
  Description of Artificial Sequence: Synthetic oligonucleotide
  modified_base (20)..(21): 2'-methoxy-nucleotide
gagccaggaggguaccagguu

SEQ ID NO: 3114 - RNA, 21 nt, Artificial Sequence
  Description of Artificial Sequence: Synthetic oligonucleotide
  modified_base (20)..(21): 2'-methoxy-nucleotide
agagccaggaggguaccaguu

SEQ ID NO: 3115 - RNA, 21 nt, Artificial Sequence
  Description of Artificial Sequence: Synthetic oligonucleotide
  modified_base (20)..(21): 2'-methoxy-nucleotide
aagagccaggaggguaccauu

SEQ ID NO: 3116 - RNA, 21 nt, Artificial Sequence
  Description of Artificial Sequence: Synthetic oligonucleotide
  modified_base (20)..(21): 2'-methoxy-nucleotide
caagagccaggaggguaccuu

SEQ ID NO: 3117 - RNA, 21 nt, Artificial Sequence
  Description of Artificial Sequence: Synthetic oligonucleotide
  modified_base (20)..(21): 2'-methoxy-nucleotide
ucaagagccaggaggguacuu

SEQ ID NO: 3118 - RNA, 21 nt, Artificial Sequence
  Description of Artificial Sequence: Synthetic oligonucleotide
  modified_base (20)..(21): 2'-methoxy-nucleotide
aucaagagccaggaggguauu

SEQ ID NO: 3119 - RNA, 21 nt, Artificial Sequence
  Description of Artificial Sequence: Synthetic oligonucleotide
  modified_base (20)..(21): 2'-methoxy-nucleotide
uaucaagagccaggaggguuu

SEQ ID NO: 3120 - RNA, 21 nt, Artificial Sequence
  Description of Artificial Sequence: Synthetic oligonucleotide
  modified_base (20)..(21): 2'-methoxy-nucleotide
guaucaagagccaggaggguu

SEQ ID NO: 3121 - RNA, 21 nt, Artificial Sequence
  Description of Artificial Sequence: Synthetic oligonucleotide
  modified_base (20)..(21): 2'-methoxy-nucleotide
gguaucaagagccaggagguu

SEQ ID NO: 3122 - RNA, 21 nt, Artificial Sequence
  Description of Artificial Sequence: Synthetic oligonucleotide
  modified_base (20)..(21): 2'-methoxy-nucleotide
ggguaucaagagccaggaguu

SEQ ID NO: 3123 - RNA, 21 nt, Artificial Sequence
  Description of Artificial Sequence: Synthetic oligonucleotide
  modified_base (20)..(21): 2'-methoxy-nucleotide
gggguaucaagagccaggauu

SEQ ID NO: 3124 - RNA, 21 nt, Artificial Sequence
  Description of Artificial Sequence: Synthetic oligonucleotide
  modified_base (20)..(21): 2'-methoxy-nucleotide
ggggguaucaagagccagguu

SEQ ID NO: 3125 - RNA, 21 nt, Artificial Sequence
  Description of Artificial Sequence: Synthetic oligonucleotide
  modified_base (20)..(21): 2'-methoxy-nucleotide
gggggguaucaagagccaguu

SEQ ID NO: 3126 - RNA, 21 nt, Artificial Sequence
  Description of Artificial Sequence: Synthetic oligonucleotide
  modified_base (20)..(21): 2'-methoxy-nucleotide
agggggguaucaagagccauu

SEQ ID NO: 3127 - RNA, 21 nt, Artificial Sequence
  Description of Artificial Sequence: Synthetic oligonucleotide
  modified_base (20)..(21): 2'-methoxy-nucleotide
gagggggguaucaagagccuu

SEQ ID NO: 3128 - RNA, 21 nt, Artificial Sequence
  Description of Artificial Sequence: Synthetic oligonucleotide
  modified_base (20)..(21): 2'-methoxy-nucleotide
agagggggguaucaagagcuu

SEQ ID NO: 3129 - RNA, 21 nt, Artificial Sequence
  Description of Artificial Sequence: Synthetic oligonucleotide
  modified_base (20)..(21): 2'-methoxy-nucleotide
cagagggggguaucaagaguu

SEQ ID NO: 3130 - RNA, 21 nt, Artificial Sequence
  Description of Artificial Sequence: Synthetic oligonucleotide
  modified_base (20)..(21): 2'-methoxy-nucleotide
acagagggggguaucaagauu

SEQ ID NO: 3131 - RNA, 21 nt, Artificial Sequence
  Description of Artificial Sequence: Synthetic oligonucleotide
  modified_base (20)..(21): 2'-methoxy-nucleotide
gacagagggggguaucaaguu

SEQ ID NO: 3132 - RNA, 21 nt, Artificial Sequence
  Description of Artificial Sequence: Synthetic oligonucleotide
  modified_base (20)..(21): 2'-methoxy-nucleotide
agacagagggggguaucaauu

SEQ ID NO: 3133 - RNA, 21 nt, Artificial Sequence
  Description of Artificial Sequence: Synthetic oligonucleotide
  modified_base (20)..(21): 2'-methoxy-nucleotide
aagacagagggggguaucauu

SEQ ID NO: 3134 - RNA, 21 nt, Artificial Sequence
  Description of Artificial Sequence: Synthetic oligonucleotide
  modified_base (20)..(21): 2'-methoxy-nucleotide
caagacagagggggguaucuu

SEQ ID NO: 3135 - RNA, 21 nt, Artificial Sequence
  Description of Artificial Sequence: Synthetic oligonucleotide
  modified_base (20)..(21): 2'-methoxy-nucleotide
acaagacagagggggguauuu

SEQ ID NO: 3136 - RNA, 21 nt, Artificial Sequence
  Description of Artificial Sequence: Synthetic oligonucleotide
  modified_base (20)..(21): 2'-methoxy-nucleotide
cacaagacagagggggguauu

SEQ ID NO: 3137 - RNA, 21 nt, Artificial Sequence
  Description of Artificial Sequence: Synthetic oligonucleotide
  modified_base (20)..(21): 2'-methoxy-nucleotide
ucacaagacagagggggguuu

SEQ ID NO: 3138 - RNA, 21 nt, Artificial Sequence
  Description of Artificial Sequence: Synthetic oligonucleotide
  modified_base (20)..(21): 2'-methoxy-nucleotide
uucacaagacagagggggguu

SEQ ID NO: 3139 - RNA, 21 nt, Artificial Sequence
  Description of Artificial Sequence: Synthetic oligonucleotide
  modified_base (20)..(21): 2'-methoxy-nucleotide
cuucacaagacagaggggguu

SEQ ID NO: 3140 - RNA, 21 nt, Artificial Sequence
  Description of Artificial Sequence: Synthetic oligonucleotide
  modified_base (20)..(21): 2'-methoxy-nucleotide
ccuucacaagacagagggguu

SEQ ID NO: 3141 - RNA, 21 nt, Artificial Sequence
  Description of Artificial Sequence: Synthetic oligonucleotide
  modified_base (20)..(21): 2'-methoxy-nucleotide
gccuucacaagacagaggguu

SEQ ID NO: 3142 - RNA, 21 nt, Artificial Sequence
  Description of Artificial Sequence: Synthetic oligonucleotide
  modified_base (20)..(21): 2'-methoxy-nucleotide
ugccuucacaagacagagguu

SEQ ID NO: 3143 - RNA, 21 nt, Artificial Sequence
  Description of Artificial Sequence: Synthetic oligonucleotide
  modified_base (20)..(21): 2'-methoxy-nucleotide
cugccuucacaagacagaguu

SEQ ID NO: 3144 - RNA, 21 nt, Artificial Sequence
  Description of Artificial Sequence: Synthetic oligonucleotide
  modified_base (20)..(21): 2'-methoxy-nucleotide
ccugccuucacaagacagauu

SEQ ID NO: 3145 - RNA, 21 nt, Artificial Sequence
  Description of Artificial Sequence: Synthetic oligonucleotide
  modified_base (20)..(21): 2'-methoxy-nucleotide
cccugccuucacaagacaguu

SEQ ID NO: 3146 - RNA, 21 nt, Artificial Sequence
  Description of Artificial Sequence: Synthetic oligonucleotide
  modified_base (20)..(21): 2'-methoxy-nucleotide
ccccugccuucacaagacauu

SEQ ID NO: 3147 - RNA, 21 nt, Artificial Sequence
  Description of Artificial Sequence: Synthetic oligonucleotide
  modified_base (20)..(21): 2'-methoxy-nucleotide
cccccugccuucacaagacuu

SEQ ID NO: 3148 - RNA, 21 nt, Artificial Sequence
  Description of Artificial Sequence: Synthetic oligonucleotide
  modified_base (20)..(21): 2'-methoxy-nucleotide
ucccccugccuucacaagauu

SEQ ID NO: 3149 - RNA, 21 nt, Artificial Sequence
  Description of Artificial Sequence: Synthetic oligonucleotide
  modified_base (20)..(21): 2'-methoxy-nucleotide
uucccccugccuucacaaguu

SEQ ID NO: 3150 - RNA, 21 nt, Artificial Sequence
  Description of Artificial Sequence: Synthetic oligonucleotide
  modified_base (20)..(21): 2'-methoxy-nucleotide
cuucccccugccuucacaauu

SEQ ID NO: 3151 - RNA, 21 nt, Artificial Sequence
  Description of Artificial Sequence: Synthetic oligonucleotide
  modified_base (20)..(21): 2'-methoxy-nucleotide
ccuucccccugccuucacauu

SEQ ID NO: 3152 - RNA, 21 nt, Artificial Sequence
  Description of Artificial Sequence: Synthetic oligonucleotide
  modified_base (20)..(21): 2'-methoxy-nucleotide
accuucccccugccuucacuu

SEQ ID NO: 3153 - RNA, 21 nt, Artificial Sequence
  Description of Artificial Sequence: Synthetic oligonucleotide
  modified_base (20)..(21): 2'-methoxy-nucleotide
caccuucccccugccuucauu

SEQ ID NO: 3154 - RNA, 21 nt, Artificial Sequence
  Description of Artificial Sequence: Synthetic oligonucleotide
  modified_base (20)..(21): 2'-methoxy-nucleotide
ccaccuucccccugccuucuu

SEQ ID NO: 3155 - RNA, 21 nt, Artificial Sequence
  Description of Artificial Sequence: Synthetic oligonucleotide
  modified_base (20)..(21): 2'-methoxy-nucleotide
cccaccuucccccugccuuuu

SEQ ID NO: 3156 - RNA, 21 nt, Artificial Sequence
  Description of Artificial Sequence: Synthetic oligonucleotide
  modified_base (20)..(21): 2'-methoxy-nucleotide
ccccaccuucccccugccuuu

SEQ ID NO: 3157 - RNA, 21 nt, Artificial Sequence
  Description of Artificial Sequence: Synthetic oligonucleotide
  modified_base (20)..(21): 2'-methoxy-nucleotide
accccaccuucccccugccuu

SEQ ID NO: 3158 - RNA, 21 nt, Artificial Sequence
  Description of Artificial Sequence: Synthetic oligonucleotide
  modified_base (20)..(21): 2'-methoxy-nucleotide
gaccccaccuucccccugcuu

SEQ ID NO: 3159 - RNA, 21 nt, Artificial Sequence
  Description of Artificial Sequence: Synthetic oligonucleotide
  modified_base (20)..(21): 2'-methoxy-nucleotide
ggaccccaccuucccccuguu

SEQ ID NO: 3160 - RNA, 21 nt, Artificial Sequence
  Description of Artificial Sequence: Synthetic oligonucleotide
  modified_base (20)..(21): 2'-methoxy-nucleotide
aggaccccaccuucccccuuu

SEQ ID NO: 3161 - RNA, 21 nt, Artificial Sequence
  Description of Artificial Sequence: Synthetic oligonucleotide
  modified_base (20)..(21): 2'-methoxy-nucleotide
caggaccccaccuucccccuu

SEQ ID NO: 3162 - RNA, 21 nt, Artificial Sequence
  Description of Artificial Sequence: Synthetic oligonucleotide
  modified_base (20)..(21): 2'-methoxy-nucleotide
ccaggaccccaccuuccccuu

SEQ ID NO: 3163 - RNA, 21 nt, Artificial Sequence
  Description of Artificial Sequence: Synthetic oligonucleotide
  modified_base (20)..(21): 2'-methoxy-nucleotide
uccaggaccccaccuucccuu

SEQ ID NO: 3164 - RNA, 21 nt, Artificial Sequence
  Description of Artificial Sequence: Synthetic oligonucleotide
  modified_base (20)..(21): 2'-methoxy-nucleotide
cuccaggaccccaccuuccuu

SEQ ID NO: 3165 - RNA, 21 nt, Artificial Sequence
  Description of Artificial Sequence: Synthetic oligonucleotide
  modified_base (20)..(21): 2'-methoxy-nucleotide
gcuccaggaccccaccuucuu

SEQ ID NO: 3166 - RNA, 21 nt, Artificial Sequence
  Description of Artificial Sequence: Synthetic oligonucleotide
  modified_base (20)..(21): 2'-methoxy-nucleotide
ugcuccaggaccccaccuuuu

SEQ ID NO: 3167 - RNA, 21 nt, Artificial Sequence
  Description of Artificial Sequence: Synthetic oligonucleotide
  modified_base (20)..(21): 2'-methoxy-nucleotide
cugcuccaggaccccaccuuu

SEQ ID NO: 3168 - RNA, 21 nt, Artificial Sequence
  Description of Artificial Sequence: Synthetic oligonucleotide
  modified_base (20)..(21): 2'-methoxy-nucleotide
ucugcuccaggaccccaccuu

SEQ ID NO: 3169 - RNA, 21 nt, Artificial Sequence
  Description of Artificial Sequence: Synthetic oligonucleotide
  modified_base (20)..(21): 2'-methoxy-nucleotide
gucugcuccaggaccccacuu

SEQ ID NO: 3170 - RNA, 21 nt, Artificial Sequence
  Description of Artificial Sequence: Synthetic oligonucleotide
  modified_base (20)..(21): 2'-methoxy-nucleotide
ggucugcuccaggaccccauu

SEQ ID NO: 3171 - RNA, 21 nt, Artificial Sequence
  Description of Artificial Sequence: Synthetic oligonucleotide
  modified_base (20)..(21): 2'-methoxy-nucleotide
uggucugcuccaggaccccuu

SEQ ID NO: 3172 - RNA, 21 nt, Artificial Sequence
  Description of Artificial Sequence: Synthetic oligonucleotide
  modified_base (20)..(21): 2'-methoxy-nucleotide
guggucugcuccaggacccuu

SEQ ID NO: 3173 - RNA, 21 nt, Artificial Sequence
  Description of Artificial Sequence: Synthetic oligonucleotide
  modified_base (20)..(21): 2'-methoxy-nucleotide
gguggucugcuccaggaccuu

SEQ ID NO: 3174 - RNA, 21 nt, Artificial Sequence
  Description of Artificial Sequence: Synthetic oligonucleotide
  modified_base (20)..(21): 2'-methoxy-nucleotide
ggguggucugcuccaggacuu

SEQ ID NO: 3175 - RNA, 21 nt, Artificial Sequence
  Description of Artificial Sequence: Synthetic oligonucleotide
  modified_base (20)..(21): 2'-methoxy-nucleotide
gggguggucugcuccaggauu

SEQ ID NO: 3176 - RNA, 21 nt, Artificial Sequence
  Description of Artificial Sequence: Synthetic oligonucleotide
  modified_base (20)..(21): 2'-methoxy-nucleotide
cgggguggucugcuccagguu

SEQ ID NO: 3177 - RNA, 21 nt, Artificial Sequence
  Description of Artificial Sequence: Synthetic oligonucleotide
  modified_base (20)..(21): 2'-methoxy-nucleotide
gcgggguggucugcuccaguu

SEQ ID NO: 3178 - RNA, 21 nt, Artificial Sequence
  Description of Artificial Sequence: Synthetic oligonucleotide
  modified_base (20)..(21): 2'-methoxy-nucleotide
ggcgggguggucugcuccauu

SEQ ID NO: 3179 - RNA, 21 nt, Artificial Sequence
  Description of Artificial Sequence: Synthetic oligonucleotide
  modified_base (20)..(21): 2'-methoxy-nucleotide
aggcgggguggucugcuccuu

SEQ ID NO: 3180 - RNA, 21 nt, Artificial Sequence
  Description of Artificial Sequence: Synthetic oligonucleotide
  modified_base (20)..(21): 2'-methoxy-nucleotide
caggcgggguggucugcucuu

SEQ ID NO: 3181 - RNA, 21 nt, Artificial Sequence
  Description of Artificial Sequence: Synthetic oligonucleotide
  modified_base (20)..(21): 2'-methoxy-nucleotide
gcaggcgggguggucugcuuu

SEQ ID NO: 3182 - RNA, 21 nt, Artificial Sequence
  Description of Artificial Sequence: Synthetic oligonucleotide
  modified_base (20)..(21): 2'-methoxy-nucleotide
ggcaggcgggguggucugcuu

SEQ ID NO: 3183 - RNA, 21 nt, Artificial Sequence
  Description of Artificial Sequence: Synthetic oligonucleotide
  modified_base (20)..(21): 2'-methoxy-nucleotide
gggcaggcgggguggucuguu

SEQ ID NO: 3184 - RNA, 21 nt, Artificial Sequence
  Description of Artificial Sequence: Synthetic oligonucleotide
  modified_base (20)..(21): 2'-methoxy-nucleotide
agggcaggcgggguggucuuu

SEQ ID NO: 3185 - RNA, 21 nt, Artificial Sequence
  Description of Artificial Sequence: Synthetic oligonucleotide
  modified_base (20)..(21): 2'-methoxy-nucleotide
gagggcaggcgggguggucuu

SEQ ID NO: 3186 - RNA, 21 nt, Artificial Sequence
  Description of Artificial Sequence: Synthetic oligonucleotide
  modified_base (20)..(21): 2'-methoxy-nucleotide
ugagggcaggcggggugguuu

SEQ ID NO: 3187 - RNA, 21 nt, Artificial Sequence
  Description of Artificial Sequence: Synthetic oligonucleotide
  modified_base (20)..(21): 2'-methoxy-nucleotide
augagggcaggcggggugguu

SEQ ID NO: 3188 - RNA, 21 nt, Artificial Sequence
  Description of Artificial Sequence: Synthetic oligonucleotide
  modified_base (20)..(21): 2'-methoxy-nucleotide
caugagggcaggcgggguguu

SEQ ID NO: 3189 - RNA, 21 nt, Artificial Sequence
  Description of Artificial Sequence: Synthetic oligonucleotide
  modified_base (20)..(21): 2'-methoxy-nucleotide
ccaugagggcaggcgggguuu

SEQ ID NO: 3190 - RNA, 21 nt, Artificial Sequence
  Description of Artificial Sequence: Synthetic oligonucleotide
  modified_base (20)..(21): 2'-methoxy-nucleotide
gccaugagggcaggcgggguu

SEQ ID NO: 3191 - RNA, 21 nt, Artificial Sequence
  Description of Artificial Sequence: Synthetic oligonucleotide
  modified_base (20)..(21): 2'-methoxy-nucleotide
ggccaugagggcaggcggguu

SEQ ID NO: 3192 - RNA, 21 nt, Artificial Sequence
  Description of Artificial Sequence: Synthetic oligonucleotide
  modified_base (20)..(21): 2'-methoxy-nucleotide
gggccaugagggcaggcgguu

SEQ ID NO: 3193 - RNA, 21 nt, Artificial Sequence
  Description of Artificial Sequence: Synthetic oligonucleotide
  modified_base (20)..(21): 2'-methoxy-nucleotide
ggggccaugagggcaggcguu

SEQ ID NO: 3194 - RNA, 21 nt, Artificial Sequence
  Description of Artificial Sequence: Synthetic oligonucleotide
  modified_base (20)..(21): 2'-methoxy-nucleotide
aggggccaugagggcaggcuu

SEQ ID NO: 3195 - RNA, 21 nt, Artificial Sequence
  Description of Artificial Sequence: Synthetic oligonucleotide
  modified_base (20)..(21): 2'-methoxy-nucleotide
gaggggccaugagggcagguu

SEQ ID NO: 3196 - RNA, 21 nt, Artificial Sequence
  Description of Artificial Sequence: Synthetic oligonucleotide
  modified_base (20)..(21): 2'-methoxy-nucleotide
agaggggccaugagggcaguu

SEQ ID NO: 3197 - RNA, 21 nt, Artificial Sequence
  Description of Artificial Sequence: Synthetic oligonucleotide
  modified_base (20)..(21): 2'-methoxy-nucleotide
cagaggggccaugagggcauu

SEQ ID NO: 3198 - RNA, 21 nt, Artificial Sequence
  Description of Artificial Sequence: Synthetic oligonucleotide
  modified_base (20)..(21): 2'-methoxy-nucleotide
ucagaggggccaugagggcuu

SEQ ID NO: 3199 - RNA, 21 nt, Artificial Sequence
  Description of Artificial Sequence: Synthetic oligonucleotide
  modified_base (20)..(21): 2'-methoxy-nucleotide
gucagaggggccaugaggguu

SEQ ID NO: 3200 - RNA, 21 nt, Artificial Sequence
  Description of Artificial Sequence: Synthetic oligonucleotide
  modified_base (20)..(21): 2'-methoxy-nucleotide
ggucagaggggccaugagguu

SEQ ID NO: 3201 - RNA, 21 nt, Artificial Sequence
  Description of Artificial Sequence: Synthetic oligonucleotide
  modified_base (20)..(21): 2'-methoxy-nucleotide
aggucagaggggccaugaguu

SEQ ID NO: 3202 - RNA, 21 nt, Artificial Sequence
  Description of Artificial Sequence: Synthetic oligonucleotide
  modified_base (20)..(21): 2'-methoxy-nucleotide
caggucagaggggccaugauu

SEQ ID NO: 3203 - RNA, 21 nt, Artificial Sequence
  Description of Artificial Sequence: Synthetic oligonucleotide
  modified_base (20)..(21): 2'-methoxy-nucleotide
gcaggucagaggggccauguu

SEQ ID NO: 3204 - RNA, 21 nt, Artificial Sequence
  Description of Artificial Sequence: Synthetic oligonucleotide
  modified_base (20)..(21): 2'-methoxy-nucleotide
ugcaggucagaggggccauuu

SEQ ID NO: 3205 - RNA, 21 nt, Artificial Sequence
  Description of Artificial Sequence: Synthetic oligonucleotide
  modified_base (20)..(21): 2'-methoxy-nucleotide
gugcaggucagaggggccauu

SEQ ID NO: 3206 - RNA, 21 nt, Artificial Sequence
  Description of Artificial Sequence: Synthetic oligonucleotide
  modified_base (20)..(21): 2'-methoxy-nucleotide
agugcaggucagaggggccuu

SEQ ID NO: 3207 - RNA, 21 nt, Artificial Sequence
  Description of Artificial Sequence: Synthetic oligonucleotide
  modified_base (20)..(21): 2'-methoxy-nucleotide
cagugcaggucagaggggcuu

SEQ ID NO: 3208 - RNA, 21 nt, Artificial Sequence
  Description of Artificial Sequence: Synthetic oligonucleotide
  modified_base (20)..(21): 2'-methoxy-nucleotide
ccagugcaggucagagggguu

SEQ ID NO: 3209 - RNA, 21 nt, Artificial Sequence
  Description of Artificial Sequence: Synthetic oligonucleotide
  modified_base (20)..(21): 2'-methoxy-nucleotide
cccagugcaggucagaggguu

SEQ ID NO: 3210 - RNA, 21 nt, Artificial Sequence
  Description of Artificial Sequence: Synthetic oligonucleotide
  modified_base (20)..(21): 2'-methoxy-nucleotide
ccccagugcaggucagagguu

SEQ ID NO: 3211 - RNA, 21 nt, Artificial Sequence
  Description of Artificial Sequence: Synthetic oligonucleotide
  modified_base (20)..(21): 2'-methoxy-nucleotide
uccccagugcaggucagaguu

SEQ ID NO: 3212 - RNA, 21 nt, Artificial Sequence
  Description of Artificial Sequence: Synthetic oligonucleotide
  modified_base (20)..(21): 2'-methoxy-nucleotide
cuccccagugcaggucagauu

SEQ ID NO: 3213 - RNA, 21 nt, Artificial Sequence
  Description of Artificial Sequence: Synthetic oligonucleotide
  modified_base (20)..(21): 2'-methoxy-nucleotide
gcuccccagugcaggucaguu

SEQ ID NO: 3214 - RNA, 21 nt, Artificial Sequence
  Description of Artificial Sequence: Synthetic oligonucleotide
  modified_base (20)..(21): 2'-methoxy-nucleotide
ggcuccccagugcaggucauu

SEQ ID NO: 3215 - RNA, 21 nt, Artificial Sequence
  Description of Artificial Sequence: Synthetic oligonucleotide
  modified_base (20)..(21): 2'-methoxy-nucleotide
gggcuccccagugcaggucuu

SEQ ID NO: 3216 - RNA, 21 nt, Artificial Sequence
  Description of Artificial Sequence: Synthetic oligonucleotide
  modified_base (20)..(21): 2'-methoxy-nucleotide
cgggcuccccagugcagguuu

SEQ ID NO: 3217 - RNA, 21 nt, Artificial Sequence
  Description of Artificial Sequence: Synthetic oligonucleotide
  modified_base (20)..(21): 2'-methoxy-nucleotide
acgggcuccccagugcagguu

SEQ ID NO: 3218 - RNA, 21 nt, Artificial Sequence
  Description of Artificial Sequence: Synthetic oligonucleotide
  modified_base (20)..(21): 2'-methoxy-nucleotide
gacgggcuccccagugcaguu

SEQ ID NO: 3219 - RNA, 21 nt, Artificial Sequence
  Description of Artificial Sequence: Synthetic oligonucleotide
  modified_base (20)..(21): 2'-methoxy-nucleotide
agacgggcuccccagugcauu

SEQ ID NO: 3220 - RNA, 21 nt, Artificial Sequence
  Description of Artificial Sequence: Synthetic oligonucleotide
  modified_base (20)..(21): 2'-methoxy-nucleotide
gagacgggcuccccagugcuu

SEQ ID NO: 3221 - RNA, 21 nt, Artificial Sequence
  Description of Artificial Sequence: Synthetic oligonucleotide
  modified_base (20)..(21): 2'-methoxy-nucleotide
ugagacgggcuccccaguguu

SEQ ID NO: 3222 - RNA, 21 nt, Artificial Sequence
  Description of Artificial Sequence: Synthetic oligonucleotide
  modified_base (20)..(21): 2'-methoxy-nucleotide
cugagacgggcuccccaguuu

SEQ ID NO: 3223 - RNA, 21 nt, Artificial Sequence
  Description of Artificial Sequence: Synthetic oligonucleotide
  modified_base (20)..(21): 2'-methoxy-nucleotide
acugagacgggcuccccaguu

SEQ ID NO: 3224 - RNA, 21 nt, Artificial Sequence
  Description of Artificial Sequence: Synthetic oligonucleotide
  modified_base (20)..(21): 2'-methoxy-nucleotide
cacugagacgggcuccccauu

SEQ ID NO: 3225 - RNA, 21 nt, Artificial Sequence
  Description of Artificial Sequence: Synthetic oligonucleotide
  modified_base (20)..(21): 2'-methoxy-nucleotide
acacugagacgggcuccccuu

SEQ ID NO: 3226 - RNA, 21 nt, Artificial Sequence
  Description of Artificial Sequence: Synthetic oligonucleotide
  modified_base (20)..(21): 2'-methoxy-nucleotide
aacacugagacgggcucccuu

SEQ ID NO: 3227 - RNA, 21 nt, Artificial Sequence
  Description of Artificial Sequence: Synthetic oligonucleotide
  modified_base (20)..(21): 2'-methoxy-nucleotide
caacacugagacgggcuccuu

SEQ ID NO: 3228 - RNA, 21 nt, Artificial Sequence
  Description of Artificial Sequence: Synthetic oligonucleotide
  modified_base (20)..(21): 2'-methoxy-nucleotide
ucaacacugagacgggcucuu

SEQ ID NO: 3229 - RNA, 21 nt, Artificial Sequence
  Description of Artificial Sequence: Synthetic oligonucleotide
  modified_base (20)..(21): 2'-methoxy-nucleotide
cucaacacugagacgggcuuu

SEQ ID NO: 3230 - RNA, 21 nt, Artificial Sequence
  Description of Artificial Sequence: Synthetic oligonucleotide
  modified_base (20)..(21): 2'-methoxy-nucleotide
gcucaacacugagacgggcuu

SEQ ID NO: 3231 - RNA, 21 nt, Artificial Sequence
  Description of Artificial Sequence: Synthetic oligonucleotide
  modified_base (20)..(21): 2'-methoxy-nucleotide
ggcucaacacugagacggguu

SEQ ID NO: 3232 - RNA, 21 nt, Artificial Sequence
  Description of Artificial Sequence: Synthetic oligonucleotide
  modified_base (20)..(21): 2'-methoxy-nucleotide
aggcucaacacugagacgguu

SEQ ID NO: 3233 - RNA, 21 nt, Artificial Sequence
  Description of Artificial Sequence: Synthetic oligonucleotide
  modified_base (20)..(21): 2'-methoxy-nucleotide
aaggcucaacacugagacguu

SEQ ID NO: 3234 - RNA, 21 nt, Artificial Sequence
  Description of Artificial Sequence: Synthetic oligonucleotide
  modified_base (20)..(21): 2'-methoxy-nucleotide
aaaggcucaacacugagacuu

SEQ ID NO: 3235 - RNA, 21 nt, Artificial Sequence
  Description of Artificial Sequence: Synthetic oligonucleotide
  modified_base (20)..(21): 2'-methoxy-nucleotide
aaaaggcucaacacugagauu

SEQ ID NO: 3236 - RNA, 21 nt, Artificial Sequence
  Description of Artificial Sequence: Synthetic oligonucleotide
  modified_base (20)..(21): 2'-methoxy-nucleotide
gaaaaggcucaacacugaguu

SEQ ID NO: 3237 - RNA, 21 nt, Artificial Sequence
  Description of Artificial Sequence: Synthetic oligonucleotide
  modified_base (20)..(21): 2'-methoxy-nucleotide
ggaaaaggcucaacacugauu

SEQ ID NO: 3238 - RNA, 21 nt, Artificial Sequence
  Description of Artificial Sequence: Synthetic oligonucleotide
  modified_base (20)..(21): 2'-methoxy-nucleotide
gggaaaaggcucaacacuguu

SEQ ID NO: 3239 - RNA, 21 nt, Artificial Sequence
  Description of Artificial Sequence: Synthetic oligonucleotide
  modified_base (20)..(21): 2'-methoxy-nucleotide
agggaaaaggcucaacacuuu

SEQ ID NO: 3240 - RNA, 21 nt, Artificial Sequence
  Description of Artificial Sequence: Synthetic oligonucleotide
  modified_base (20)..(21): 2'-methoxy-nucleotide
gagggaaaaggcucaacacuu

SEQ ID NO: 3241 - RNA, 21 nt, Artificial Sequence
  Description of Artificial Sequence: Synthetic oligonucleotide
  modified_base (20)..(21): 2'-methoxy-nucleotide
agagggaaaaggcucaacauu

SEQ ID NO: 3242 - RNA, 21 nt, Artificial Sequence
  Description of Artificial Sequence: Synthetic oligonucleotide
  modified_base (20)..(21): 2'-methoxy-nucleotide
aagagggaaaaggcucaacuu

SEQ ID NO: 3243 - RNA, 21 nt, Artificial Sequence
  Description of Artificial Sequence: Synthetic oligonucleotide
  modified_base (20)..(21): 2'-methoxy-nucleotide
aaagagggaaaaggcucaauu

SEQ ID NO: 3244 - RNA, 21 nt, Artificial Sequence
  Description of Artificial Sequence: Synthetic oligonucleotide
  modified_base (20)..(21): 2'-methoxy-nucleotide
caaagagggaaaaggcucauu

SEQ ID NO: 3245 - RNA, 21 nt, Artificial Sequence
  Description of Artificial Sequence: Synthetic oligonucleotide
  modified_base (20)..(21): 2'-methoxy-nucleotide
ccaaagagggaaaaggcucuu

SEQ ID NO: 3246 - RNA, 21 nt, Artificial Sequence
  Description of Artificial Sequence: Synthetic oligonucleotide
  modified_base (20)..(21): 2'-methoxy-nucleotide
gccaaagagggaaaaggcuuu

SEQ ID NO: 3247 - RNA, 21 nt, Artificial Sequence
  Description of Artificial Sequence: Synthetic oligonucleotide
  modified_base (20)..(21): 2'-methoxy-nucleotide
agccaaagagggaaaaggcuu

SEQ ID NO: 3248 - RNA, 21 nt, Artificial Sequence
  Description of Artificial Sequence: Synthetic oligonucleotide
  modified_base (20)..(21): 2'-methoxy-nucleotide
gagccaaagagggaaaagguu

SEQ ID NO: 3249 - RNA, 21 nt, Artificial Sequence
  Description of Artificial Sequence: Synthetic oligonucleotide
  modified_base (20)..(21): 2'-methoxy-nucleotide
ggagccaaagagggaaaaguu

SEQ ID NO: 3250 - RNA, 21 nt, Artificial Sequence
  Description of Artificial Sequence: Synthetic oligonucleotide
  modified_base (20)..(21): 2'-methoxy-nucleotide
gggagccaaagagggaaaauu

SEQ ID NO: 3251 - RNA, 21 nt, Artificial Sequence
  Description of Artificial Sequence: Synthetic oligonucleotide
  modified_base (20)..(21): 2'-methoxy-nucleotide
ggggagccaaagagggaaauu

SEQ ID NO: 3252 - RNA, 21 nt, Artificial Sequence
  Description of Artificial Sequence: Synthetic oligonucleotide
  modified_base (20)..(21): 2'-methoxy-nucleotide
aggggagccaaagagggaauu

SEQ ID NO: 3253 - RNA, 21 nt, Artificial Sequence
  Description of Artificial Sequence: Synthetic oligonucleotide
  modified_base (20)..(21): 2'-methoxy-nucleotide
caggggagccaaagagggauu

SEQ ID NO: 3254 - RNA, 21 nt, Artificial Sequence
  Description of Artificial Sequence: Synthetic oligonucleotide
  modified_base (20)..(21): 2'-methoxy-nucleotide
acaggggagccaaagaggguu

SEQ ID NO: 3255 - RNA, 21 nt, Artificial Sequence
  Description of Artificial Sequence: Synthetic oligonucleotide
  modified_base (20)..(21): 2'-methoxy-nucleotide
uacaggggagccaaagagguu

SEQ ID NO: 3256 - RNA, 21 nt, Artificial Sequence
  Description of Artificial Sequence: Synthetic oligonucleotide
  modified_base (20)..(21): 2'-methoxy-nucleotide
guacaggggagccaaagaguu

SEQ ID NO: 3257 - RNA, 21 nt, Artificial Sequence
  Description of Artificial Sequence: Synthetic oligonucleotide
  modified_base (20)..(21): 2'-methoxy-nucleotide
gguacaggggagccaaagauu

SEQ ID NO: 3258 - RNA, 21 nt, Artificial Sequence
  Description of Artificial Sequence: Synthetic oligonucleotide
  modified_base (20)..(21): 2'-methoxy-nucleotide
agguacaggggagccaaaguu

SEQ ID NO: 3259 - RNA, 21 nt, Artificial Sequence
  Description of Artificial Sequence: Synthetic oligonucleotide
  modified_base (20)..(21): 2'-methoxy-nucleotide
aagguacaggggagccaaauu

SEQ ID NO: 3260 - RNA, 21 nt, Artificial Sequence
  Description of Artificial Sequence: Synthetic oligonucleotide
  modified_base (20)..(21): 2'-methoxy-nucleotide
aaagguacaggggagccaauu

SEQ ID NO: 3261 - RNA, 21 nt, Artificial Sequence
  Description of Artificial Sequence: Synthetic oligonucleotide
  modified_base (20)..(21): 2'-methoxy-nucleotide
aaaagguacaggggagccauu

SEQ ID NO: 3262 - RNA, 21 nt, Artificial Sequence
  Description of Artificial Sequence: Synthetic oligonucleotide
  modified_base (20)..(21): 2'-methoxy-nucleotide
caaaagguacaggggagccuu

SEQ ID NO: 3263 - RNA, 21 nt, Artificial Sequence
  Description of Artificial Sequence: Synthetic oligonucleotide
  modified_base (20)..(21): 2'-methoxy-nucleotide
ucaaaagguacaggggagcuu

SEQ ID NO: 3264 - RNA, 21 nt, Artificial Sequence
  Description of Artificial Sequence: Synthetic oligonucleotide
  modified_base (20)..(21): 2'-methoxy-nucleotide
cucaaaagguacaggggaguu

SEQ ID NO: 3265 - RNA, 21 nt, Artificial Sequence
  Description of Artificial Sequence: Synthetic oligonucleotide
  modified_base (20)..(21): 2'-methoxy-nucleotide
ccucaaaagguacaggggauu

SEQ ID NO: 3266 - RNA, 21 nt, Artificial Sequence
  Description of Artificial Sequence: Synthetic oligonucleotide
  modified_base (20)..(21): 2'-methoxy-nucleotide
uccucaaaagguacagggguu

SEQ ID NO: 3267 - RNA, 21 nt, Artificial Sequence
  Description of Artificial Sequence: Synthetic oligonucleotide
  modified_base (20)..(21): 2'-methoxy-nucleotide
cuccucaaaagguacaggguu

SEQ ID NO: 3268 - RNA, 21 nt, Artificial Sequence
  Description of Artificial Sequence: Synthetic oligonucleotide
  modified_base (20)..(21): 2'-methoxy-nucleotide
gcuccucaaaagguacagguu

SEQ ID NO: 3269 - RNA, 21 nt, Artificial Sequence
  Description of Artificial Sequence: Synthetic oligonucleotide
  modified_base (20)..(21): 2'-methoxy-nucleotide
ggcuccucaaaagguacaguu

SEQ ID NO: 3270 - RNA, 21 nt, Artificial Sequence
  Description of Artificial Sequence: Synthetic oligonucleotide
  modified_base (20)..(21): 2'-methoxy-nucleotide
gggcuccucaaaagguacauu

SEQ ID NO: 3271 - RNA, 21 nt, Artificial Sequence
  Description of Artificial Sequence: Synthetic oligonucleotide
  modified_base (20)..(21): 2'-methoxy-nucleotide
ggggcuccucaaaagguacuu

SEQ ID NO: 3272 - RNA, 21 nt, Artificial Sequence
  Description of Artificial Sequence: Synthetic oligonucleotide
  modified_base (20)..(21): 2'-methoxy-nucleotide
uggggcuccucaaaagguauu

SEQ ID NO: 3273 - RNA, 21 nt, Artificial Sequence
  Description of Artificial Sequence: Synthetic oligonucleotide
  modified_base (20)..(21): 2'-methoxy-nucleotide
cuggggcuccucaaaagguuu

SEQ ID NO: 3274 - RNA, 21 nt, Artificial Sequence
  Description of Artificial Sequence: Synthetic oligonucleotide
  modified_base (20)..(21): 2'-methoxy-nucleotide
gcuggggcuccucaaaagguu

SEQ ID NO: 3275 - RNA, 21 nt, Artificial Sequence
  Description of Artificial Sequence: Synthetic oligonucleotide
  modified_base (20)..(21): 2'-methoxy-nucleotide
agcuggggcuccucaaaaguu

SEQ ID NO: 3276 - RNA, 21 nt, Artificial Sequence
  Description of Artificial Sequence: Synthetic oligonucleotide
  modified_base (20)..(21): 2'-methoxy-nucleotide
uagcuggggcuccucaaaauu

SEQ ID NO: 3277 - RNA, 21 nt, Artificial Sequence
  Description of Artificial Sequence: Synthetic oligonucleotide
  modified_base (20)..(21): 2'-methoxy-nucleotide
guagcuggggcuccucaaauu

SEQ ID NO: 3278 - RNA, 21 nt, Artificial Sequence
  Description of Artificial Sequence: Synthetic oligonucleotide
  modified_base (20)..(21): 2'-methoxy-nucleotide
gguagcuggggcuccucaauu

SEQ ID NO: 3279 - RNA, 21 nt, Artificial Sequence
  Description of Artificial Sequence: Synthetic oligonucleotide
  modified_base (20)..(21): 2'-methoxy-nucleotide
ggguagcuggggcuccucauu

SEQ ID NO: 3280 - RNA, 21 nt, Artificial Sequence
  Description of Artificial Sequence: Synthetic oligonucleotide
  modified_base (20)..(21): 2'-methoxy-nucleotide
aggguagcuggggcuccucuu

SEQ ID NO: 3281 - RNA, 21 nt, Artificial Sequence
  Description of Artificial Sequence: Synthetic oligonucleotide
  modified_base (20)..(21): 2'-methoxy-nucleotide
aaggguagcuggggcuccuuu

SEQ ID NO: 3282 - RNA, 21 nt, Artificial Sequence
  Description of Artificial Sequence: Synthetic oligonucleotide
  modified_base (20)..(21): 2'-methoxy-nucleotide
gaaggguagcuggggcuccuu

SEQ ID NO: 3283 - RNA, 21 nt, Artificial Sequence
  Description of Artificial Sequence: Synthetic oligonucleotide
  modified_base (20)..(21): 2'-methoxy-nucleotide
agaaggguagcuggggcucuu

SEQ ID NO: 3284 - RNA, 21 nt, Artificial Sequence
  Description of Artificial Sequence: Synthetic oligonucleotide
  modified_base (20)..(21): 2'-methoxy-nucleotide
aagaaggguagcuggggcuuu

SEQ ID NO: 3285 - RNA, 21 nt, Artificial Sequence
  Description of Artificial Sequence: Synthetic oligonucleotide
  modified_base (20)..(21): 2'-methoxy-nucleotide
gaagaaggguagcuggggcuu

SEQ ID NO: 3286 - RNA, 21 nt, Artificial Sequence
  Description of Artificial Sequence: Synthetic oligonucleotide
  modified_base (20)..(21): 2'-methoxy-nucleotide
agaagaaggguagcugggguu

SEQ ID NO: 3287 - RNA, 21 nt, Artificial Sequence
  Description of Artificial Sequence: Synthetic oligonucleotide
  modified_base (20)..(21): 2'-methoxy-nucleotide
gagaagaaggguagcuggguu

SEQ ID NO: 3288 - RNA, 21 nt, Artificial Sequence
  Description of Artificial Sequence: Synthetic oligonucleotide
  modified_base (20)..(21): 2'-methoxy-nucleotide
ggagaagaaggguagcugguu

SEQ ID NO: 3289 - RNA, 21 nt, Artificial Sequence
  Description of Artificial Sequence: Synthetic oligonucleotide
  modified_base (20)..(21): 2'-methoxy-nucleotide
uggagaagaaggguagcuguu

SEQ ID NO: 3290 - RNA, 21 nt, Artificial Sequence
  Description of Artificial Sequence: Synthetic oligonucleotide
  modified_base (20)..(21): 2'-methoxy-nucleotide
cuggagaagaaggguagcuuu

SEQ ID NO: 3291 - RNA, 21 nt, Artificial Sequence
  Description of Artificial Sequence: Synthetic oligonucleotide
  modified_base (20)..(21): 2'-methoxy-nucleotide
gcuggagaagaaggguagcuu

SEQ ID NO: 3292 - RNA, 21 nt, Artificial Sequence
  Description of Artificial Sequence: Synthetic oligonucleotide
  modified_base (20)..(21): 2'-methoxy-nucleotide
agcuggagaagaaggguaguu

SEQ ID NO: 3293 - RNA, 21 nt, Artificial Sequence
  Description of Artificial Sequence: Synthetic oligonucleotide
  modified_base (20)..(21): 2'-methoxy-nucleotide
cagcuggagaagaaggguauu

SEQ ID NO: 3294 - RNA, 21 nt, Artificial Sequence
  Description of Artificial Sequence: Synthetic oligonucleotide
  modified_base (20)..(21): 2'-methoxy-nucleotide
ccagcuggagaagaaggguuu

SEQ ID NO: 3295 - RNA, 21 nt, Artificial Sequence
  Description of Artificial Sequence: Synthetic oligonucleotide
  modified_base (20)..(21): 2'-methoxy-nucleotide
cccagcuggagaagaaggguu

SEQ ID NO: 3296 - RNA, 21 nt, Artificial Sequence
  Description of Artificial Sequence: Synthetic oligonucleotide
  modified_base (20)..(21): 2'-methoxy-nucleotide
gcccagcuggagaagaagguu

SEQ ID NO: 3297 - RNA, 21 nt, Artificial Sequence
  Description of Artificial Sequence: Synthetic oligonucleotide
  modified_base (20)..(21): 2'-methoxy-nucleotide
agcccagcuggagaagaaguu

SEQ ID NO: 3298 - RNA, 21 nt, Artificial Sequence
  Description of Artificial Sequence: Synthetic oligonucleotide
  modified_base (20)..(21): 2'-methoxy-nucleotide
gagcccagcuggagaagaauu

SEQ ID NO: 3299 - RNA, 21 nt, Artificial Sequence
  Description of Artificial Sequence: Synthetic oligonucleotide
  modified_base (20)..(21): 2'-methoxy-nucleotide
agagcccagcuggagaagauu

SEQ ID NO: 3300 - RNA, 21 nt, Artificial Sequence
  Description of Artificial Sequence: Synthetic oligonucleotide
  modified_base (20)..(21): 2'-methoxy-nucleotide
cagagcccagcuggagaaguu

SEQ ID NO: 3301 - RNA, 21 nt, Artificial Sequence
  Description of Artificial Sequence: Synthetic oligonucleotide
  modified_base (20)..(21): 2'-methoxy-nucleotide
gcagagcccagcuggagaauu

SEQ ID NO: 3302 - RNA, 21 nt, Artificial Sequence
  Description of Artificial Sequence: Synthetic oligonucleotide
  modified_base (20)..(21): 2'-methoxy-nucleotide
ugcagagcccagcuggagauu

SEQ ID NO: 3303 - RNA, 21 nt, Artificial Sequence
  Description of Artificial Sequence: Synthetic oligonucleotide
  modified_base (20)..(21): 2'-methoxy-nucleotide
uugcagagcccagcuggaguu

SEQ ID NO: 3304 - RNA, 21 nt, Artificial Sequence
  Description of Artificial Sequence: Synthetic oligonucleotide
  modified_base (20)..(21): 2'-methoxy-nucleotide
auugcagagcccagcuggauu

SEQ ID NO: 3305 - RNA, 21 nt, Artificial Sequence
  Description of Artificial Sequence: Synthetic oligonucleotide
  modified_base (20)..(21): 2'-methoxy-nucleotide
aauugcagagcccagcugguu

SEQ ID NO: 3306 - RNA, 21 nt, Artificial Sequence
  Description of Artificial Sequence: Synthetic oligonucleotide
  modified_base (20)..(21): 2'-methoxy-nucleotide
gaauugcagagcccagcuguu

SEQ ID NO: 3307 - RNA, 21 nt, Artificial Sequence
  Description of Artificial Sequence: Synthetic oligonucleotide
  modified_base (20)..(21): 2'-methoxy-nucleotide
ggaauugcagagcccagcuuu

SEQ ID NO: 3308 - RNA, 21 nt, Artificial Sequence
  Description of Artificial Sequence: Synthetic oligonucleotide
  modified_base (20)..(21): 2'-methoxy-nucleotide
gggaauugcagagcccagcuu

SEQ ID NO: 3309 - RNA, 21 nt, Artificial Sequence
  Description of Artificial Sequence: Synthetic oligonucleotide
  modified_base (20)..(21): 2'-methoxy-nucleotide
ggggaauugcagagcccaguu

SEQ ID NO: 3310 - RNA, 21 nt, Artificial Sequence
  Description of Artificial Sequence: Synthetic oligonucleotide
  modified_base (20)..(21): 2'-methoxy-nucleotide
aggggaauugcagagcccauu

SEQ ID NO: 3311 - RNA, 21 nt, Artificial Sequence
  Description of Artificial Sequence: Synthetic oligonucleotide
  modified_base (20)..(21): 2'-methoxy-nucleotide
gaggggaauugcagagcccuu

SEQ ID NO: 3312 - RNA, 21 nt, Artificial Sequence
  Description of Artificial Sequence: Synthetic oligonucleotide
  modified_base (20)..(21): 2'-methoxy-nucleotide
agaggggaauugcagagccuu

SEQ ID NO: 3313 - RNA, 21 nt, Artificial Sequence
  Description of Artificial Sequence: Synthetic oligonucleotide
  modified_base (20)..(21): 2'-methoxy-nucleotide
cagaggggaauugcagagcuu

SEQ ID NO: 3314 - RNA, 21 nt, Artificial Sequence
  Description of Artificial Sequence: Synthetic oligonucleotide
  modified_base (20)..(21): 2'-methoxy-nucleotide
gcagaggggaauugcagaguu

SEQ ID NO: 3315 - RNA, 21 nt, Artificial Sequence
  Description of Artificial Sequence: Synthetic oligonucleotide
  modified_base (20)..(21): 2'-methoxy-nucleotide
agcagaggggaauugcagauu

SEQ ID NO: 3316 - RNA, 21 nt, Artificial Sequence
  Description of Artificial Sequence: Synthetic oligonucleotide
  modified_base (20)..(21): 2'-methoxy-nucleotide
cagcagaggggaauugcaguu

SEQ ID NO: 3317 - RNA, 21 nt, Artificial Sequence
  Description of Artificial Sequence: Synthetic oligonucleotide
  modified_base (20)..(21): 2'-methoxy-nucleotide
gcagcagaggggaauugcauu

SEQ ID NO: 3318 - RNA, 21 nt, Artificial Sequence
  Description of Artificial Sequence: Synthetic oligonucleotide
  modified_base (20)..(21): 2'-methoxy-nucleotide
agcagcagaggggaauugcuu

SEQ ID NO: 3319 - RNA, 21 nt, Artificial Sequence
  Description of Artificial Sequence: Synthetic oligonucleotide
  modified_base (20)..(21): 2'-methoxy-nucleotide
cagcagcagaggggaauuguu

SEQ ID NO: 3320 - RNA, 21 nt, Artificial Sequence
  Description of Artificial Sequence: Synthetic oligonucleotide
  modified_base (20)..(21): 2'-methoxy-nucleotide
acagcagcagaggggaauuuu

SEQ ID NO: 3321 - RNA, 21 nt, Artificial Sequence
  Description of Artificial Sequence: Synthetic oligonucleotide
  modified_base (20)..(21): 2'-methoxy-nucleotide
gacagcagcagaggggaauuu

SEQ ID NO: 3322 - RNA, 21 nt, Artificial Sequence
  Description of Artificial Sequence: Synthetic oligonucleotide
  modified_base (20)..(21): 2'-methoxy-nucleotide
ggacagcagcagaggggaauu

SEQ ID NO: 3323 - RNA, 21 nt, Artificial Sequence
  Description of Artificial Sequence: Synthetic oligonucleotide
  modified_base (20)..(21): 2'-methoxy-nucleotide
gggacagcagcagaggggauu

SEQ ID NO: 3324 - RNA, 21 nt, Artificial Sequence
  Description of Artificial Sequence: Synthetic oligonucleotide
  modified_base (20)..(21): 2'-methoxy-nucleotide
agggacagcagcagagggguu

SEQ ID NO: 3325 - RNA, 21 nt, Artificial Sequence
  Description of Artificial Sequence: Synthetic oligonucleotide
  modified_base (20)..(21): 2'-methoxy-nucleotide
gagggacagcagcagaggguu

SEQ ID NO: 3326 - RNA, 21 nt, Artificial Sequence
  Description of Artificial Sequence: Synthetic oligonucleotide
  modified_base (20)..(21): 2'-methoxy-nucleotide
ggagggacagcagcagagguu

SEQ ID NO: 3327 - RNA, 21 nt, Artificial Sequence
  Description of Artificial Sequence: Synthetic oligonucleotide
  modified_base (20)..(21): 2'-methoxy-nucleotide
gggagggacagcagcagaguu

SEQ ID NO: 3328 - RNA, 21 nt, Artificial Sequence
  Description of Artificial Sequence: Synthetic oligonucleotide
  modified_base (20)..(21): 2'-methoxy-nucleotide
ggggagggacagcagcagauu

SEQ ID NO: 3329 - RNA, 21 nt, Artificial Sequence
  Description of Artificial Sequence: Synthetic oligonucleotide
  modified_base (20)..(21): 2'-methoxy-nucleotide
gggggagggacagcagcaguu

SEQ ID NO: 3330 - RNA, 21 nt, Artificial Sequence
  Description of Artificial Sequence: Synthetic oligonucleotide
  modified_base (20)..(21): 2'-methoxy-nucleotide
agggggagggacagcagcauu

SEQ ID NO: 3331 - RNA, 21 nt, Artificial Sequence
  Description of Artificial Sequence: Synthetic oligonucleotide
  modified_base (20)..(21): 2'-methoxy-nucleotide
aagggggagggacagcagcuu

SEQ ID NO: 3332 - RNA, 21 nt, Artificial Sequence
  Description of Artificial Sequence: Synthetic oligonucleotide
  modified_base (20)..(21): 2'-methoxy-nucleotide
caagggggagggacagcaguu

SEQ ID NO: 3333 - RNA, 21 nt, Artificial Sequence
  Description of Artificial Sequence: Synthetic oligonucleotide
  modified_base (20)..(21): 2'-methoxy-nucleotide
acaagggggagggacagcauu

SEQ ID NO: 3334 - RNA, 21 nt, Artificial Sequence
  Description of Artificial Sequence: Synthetic oligonucleotide
  modified_base (20)..(21): 2'-methoxy-nucleotide
gacaagggggagggacagcuu

SEQ ID NO: 3335 - RNA, 21 nt, Artificial Sequence
  Description of Artificial Sequence: Synthetic oligonucleotide
  modified_base (20)..(21): 2'-methoxy-nucleotide
ggacaagggggagggacaguu

SEQ ID NO: 3336 - RNA, 21 nt, Artificial Sequence
  Description of Artificial Sequence: Synthetic oligonucleotide
  modified_base (20)..(21): 2'-methoxy-nucleotide
aggacaagggggagggacauu

SEQ ID NO: 3337 - RNA, 21 nt, Artificial Sequence
  Description of Artificial Sequence: Synthetic oligonucleotide
  modified_base (20)..(21): 2'-methoxy-nucleotide
aaggacaagggggagggacuu

SEQ ID NO: 3338 - RNA, 21 nt, Artificial Sequence
  Description of Artificial Sequence: Synthetic oligonucleotide
  modified_base (20)..(21): 2'-methoxy-nucleotide
aaaggacaagggggagggauu

SEQ ID NO: 3339 - RNA, 21 nt, Artificial Sequence
  Description of Artificial Sequence: Synthetic oligonucleotide
  modified_base (20)..(21): 2'-methoxy-nucleotide
gaaaggacaagggggaggguu

SEQ ID NO: 3340 - RNA, 21 nt, Artificial Sequence
  Description of Artificial Sequence: Synthetic oligonucleotide
  modified_base (20)..(21): 2'-methoxy-nucleotide
ggaaaggacaagggggagguu

SEQ ID NO: 3341 - RNA, 21 nt, Artificial Sequence
  Description of Artificial Sequence: Synthetic oligonucleotide
  modified_base (20)..(21): 2'-methoxy-nucleotide
gggaaaggacaagggggaguu

SEQ ID NO: 3342 - RNA, 21 nt, Artificial Sequence
  Description of Artificial Sequence: Synthetic oligonucleotide
  modified_base (20)..(21): 2'-methoxy-nucleotide
agggaaaggacaagggggauu

SEQ ID NO: 3343 - RNA, 21 nt, Artificial Sequence
  Description of Artificial Sequence: Synthetic oligonucleotide
  modified_base (20)..(21): 2'-methoxy-nucleotide
aagggaaaggacaaggggguu

SEQ ID NO: 3344 - RNA, 21 nt, Artificial Sequence
  Description of Artificial Sequence: Synthetic oligonucleotide
  modified_base (20)..(21): 2'-methoxy-nucleotide
gaagggaaaggacaagggguu

SEQ ID NO: 3345 - RNA, 21 nt, Artificial Sequence
  Description of Artificial Sequence: Synthetic oligonucleotide
  modified_base (20)..(21): 2'-methoxy-nucleotide
ugaagggaaaggacaaggguu

SEQ ID NO: 3346 - RNA, 21 nt, Artificial Sequence
  Description of Artificial Sequence: Synthetic oligonucleotide
  modified_base (20)..(21): 2'-methoxy-nucleotide
cugaagggaaaggacaagguu

SEQ ID NO: 3347 - RNA, 21 nt, Artificial Sequence
  Description of Artificial Sequence: Synthetic oligonucleotide
  modified_base (20)..(21): 2'-methoxy-nucleotide
acugaagggaaaggacaaguu

SEQ ID NO: 3348 - RNA, 21 nt, Artificial Sequence
  Description of Artificial Sequence: Synthetic oligonucleotide
  modified_base (20)..(21): 2'-methoxy-nucleotide
uacugaagggaaaggacaauu

SEQ ID NO: 3349 - RNA, 21 nt, Artificial Sequence
  Description of Artificial Sequence: Synthetic oligonucleotide
  modified_base (20)..(21): 2'-methoxy-nucleotide
guacugaagggaaaggacauu

SEQ ID NO: 3350 - RNA, 21 nt, Artificial Sequence
  Description of Artificial Sequence: Synthetic oligonucleotide
  modified_base (20)..(21): 2'-methoxy-nucleotide
gguacugaagggaaaggacuu

SEQ ID NO: 3351 - RNA, 21 nt, Artificial Sequence
  Description of Artificial Sequence: Synthetic oligonucleotide
  modified_base (20)..(21): 2'-methoxy-nucleotide
ggguacugaagggaaaggauu

SEQ ID NO: 3352 - RNA, 21 nt, Artificial Sequence
  Description of Artificial Sequence: Synthetic oligonucleotide
  modified_base (20)..(21): 2'-methoxy-nucleotide
aggguacugaagggaaagguu

SEQ ID NO: 3353 - RNA, 21 nt, Artificial Sequence
  Description of Artificial Sequence: Synthetic oligonucleotide
  modified_base (20)..(21): 2'-methoxy-nucleotide
gaggguacugaagggaaaguu

SEQ ID NO: 3354 - RNA, 21 nt, Artificial Sequence
  Description of Artificial Sequence: Synthetic oligonucleotide
  modified_base (20)..(21): 2'-methoxy-nucleotide
agaggguacugaagggaaauu

SEQ ID NO: 3355 - RNA, 21 nt, Artificial Sequence
  Description of Artificial Sequence: Synthetic oligonucleotide
  modified_base (20)..(21): 2'-methoxy-nucleotide
gagaggguacugaagggaauu

SEQ ID NO: 3356 - RNA, 21 nt, Artificial Sequence
  Description of Artificial Sequence: Synthetic oligonucleotide
  modified_base (20)..(21): 2'-methoxy-nucleotide
ugagaggguacugaagggauu

SEQ ID NO: 3357 - RNA, 21 nt, Artificial Sequence
  Description of Artificial Sequence: Synthetic oligonucleotide
  modified_base (20)..(21): 2'-methoxy-nucleotide
cugagaggguacugaaggguu

SEQ ID NO: 3358 - RNA, 21 nt, Artificial Sequence
  Description of Artificial Sequence: Synthetic oligonucleotide
  modified_base (20)..(21): 2'-methoxy-nucleotide
gcugagaggguacugaagguu

SEQ ID NO: 3359 - RNA, 21 nt, Artificial Sequence
  Description of Artificial Sequence: Synthetic oligonucleotide
  modified_base (20)..(21): 2'-methoxy-nucleotide
agcugagaggguacugaaguu

SEQ ID NO: 3360 - RNA, 21 nt, Artificial Sequence
  Description of Artificial Sequence: Synthetic oligonucleotide
  modified_base (20)..(21): 2'-methoxy-nucleotide
gagcugagaggguacugaauu

SEQ ID NO: 3361 - RNA, 21 nt, Artificial Sequence
  Description of Artificial Sequence: Synthetic oligonucleotide
  modified_base (20)..(21): 2'-methoxy-nucleotide
ggagcugagaggguacugauu

SEQ ID NO: 3362 - RNA, 21 nt, Artificial Sequence
  Description of Artificial Sequence: Synthetic oligonucleotide
  modified_base (20)..(21): 2'-methoxy-nucleotide
uggagcugagaggguacuguu

SEQ ID NO: 3363 - RNA, 21 nt, Artificial Sequence
  Description of Artificial Sequence: Synthetic oligonucleotide
  modified_base (20)..(21): 2'-methoxy-nucleotide
cuggagcugagaggguacuuu

SEQ ID NO: 3364 - RNA, 21 nt, Artificial Sequence
  Description of Artificial Sequence: Synthetic oligonucleotide
  modified_base (20)..(21): 2'-methoxy-nucleotide
ccuggagcugagaggguacuu

SEQ ID NO: 3365 - RNA, 21 nt, Artificial Sequence
  Description of Artificial Sequence: Synthetic oligonucleotide
  modified_base (20)..(21): 2'-methoxy-nucleotide
accuggagcugagaggguauu

SEQ ID NO: 3366 - RNA, 21 nt, Artificial Sequence
  Description of Artificial Sequence: Synthetic oligonucleotide
  modified_base (20)..(21): 2'-methoxy-nucleotide
caccuggagcugagaggguuu

SEQ ID NO: 3367 - RNA, 21 nt, Artificial Sequence
  Description of Artificial Sequence: Synthetic oligonucleotide
  modified_base (20)..(21): 2'-methoxy-nucleotide
ccaccuggagcugagaggguu

SEQ ID NO: 3368 - RNA, 21 nt, Artificial Sequence
  Description of Artificial Sequence: Synthetic oligonucleotide
  modified_base (20)..(21): 2'-methoxy-nucleotide
gccaccuggagcugagagguu

SEQ ID NO: 3369 - RNA, 21 nt, Artificial Sequence
  Description of Artificial Sequence: Synthetic oligonucleotide
  modified_base (20)..(21): 2'-methoxy-nucleotide
agccaccuggagcugagaguu

SEQ ID NO: 3370 - RNA, 21 nt, Artificial Sequence
  Description of Artificial Sequence: Synthetic oligonucleotide
  modified_base (20)..(21): 2'-methoxy-nucleotide
gagccaccuggagcugagauu

SEQ ID NO: 3371 - RNA, 21 nt, Artificial Sequence
  Description of Artificial Sequence: Synthetic oligonucleotide
  modified_base (20)..(21): 2'-methoxy-nucleotide
agagccaccuggagcugaguu

SEQ ID NO: 3372 - RNA, 21 nt, Artificial Sequence
  Description of Artificial Sequence: Synthetic oligonucleotide
  modified_base (20)..(21): 2'-methoxy-nucleotide
cagagccaccuggagcugauu

SEQ ID NO: 3373 - RNA, 21 nt, Artificial Sequence
  Description of Artificial Sequence: Synthetic oligonucleotide
  modified_base (20)..(21): 2'-methoxy-nucleotide
ucagagccaccuggagcuguu

SEQ ID NO: 3374 - RNA, 21 nt, Artificial Sequence
  Description of Artificial Sequence: Synthetic oligonucleotide
  modified_base (20)..(21): 2'-methoxy-nucleotide
cucagagccaccuggagcuuu

SEQ ID NO: 3375 - RNA, 21 nt, Artificial Sequence
  Description of Artificial Sequence: Synthetic oligonucleotide
  modified_base (20)..(21): 2'-methoxy-nucleotide
ccucagagccaccuggagcuu

SEQ ID NO: 3376 - RNA, 21 nt, Artificial Sequence
  Description of Artificial Sequence: Synthetic oligonucleotide
  modified_base (20)..(21): 2'-methoxy-nucleotide
accucagagccaccuggaguu

SEQ ID NO: 3377 - RNA, 21 nt, Artificial Sequence
  Description of Artificial Sequence: Synthetic oligonucleotide
  modified_base (20)..(21): 2'-methoxy-nucleotide
caccucagagccaccuggauu

SEQ ID NO: 3378 - RNA, 21 nt, Artificial Sequence
  Description of Artificial Sequence: Synthetic oligonucleotide
  modified_base (20)..(21): 2'-methoxy-nucleotide
gcaccucagagccaccugguu

SEQ ID NO: 3379 - RNA, 21 nt, Artificial Sequence
  Description of Artificial Sequence: Synthetic oligonucleotide
  modified_base (20)..(21): 2'-methoxy-nucleotide
ggcaccucagagccaccuguu

SEQ ID NO: 3380 - RNA, 21 nt, Artificial Sequence
  Description of Artificial Sequence: Synthetic oligonucleotide
  modified_base (20)..(21): 2'-methoxy-nucleotide
aggcaccucagagccaccuuu

SEQ ID NO: 3381 - RNA, 21 nt, Artificial Sequence
  Description of Artificial Sequence: Synthetic oligonucleotide
  modified_base (20)..(21): 2'-methoxy-nucleotide
caggcaccucagagccaccuu

SEQ ID NO: 3382 - RNA, 21 nt, Artificial Sequence
  Description of Artificial Sequence: Synthetic oligonucleotide
  modified_base (20)..(21): 2'-methoxy-nucleotide
acaggcaccucagagccacuu

SEQ ID NO: 3383 - RNA, 21 nt, Artificial Sequence
  Description of Artificial Sequence: Synthetic oligonucleotide
  modified_base (20)..(21): 2'-methoxy-nucleotide
gacaggcaccucagagccauu

SEQ ID NO: 3384 - RNA, 21 nt, Artificial Sequence
  Description of Artificial Sequence: Synthetic oligonucleotide
  modified_base (20)..(21): 2'-methoxy-nucleotide
ggacaggcaccucagagccuu

SEQ ID NO: 3385 - RNA, 21 nt, Artificial Sequence
  Description of Artificial Sequence: Synthetic oligonucleotide
  modified_base (20)..(21): 2'-methoxy-nucleotide
gggacaggcaccucagagcuu

SEQ ID NO: 3386 - RNA, 21 nt, Artificial Sequence
  Description of Artificial Sequence: Synthetic oligonucleotide
  modified_base (20)..(21): 2'-methoxy-nucleotide
ugggacaggcaccucagaguu

SEQ ID NO: 3387 - RNA, 21 nt, Artificial Sequence
  Description of Artificial Sequence: Synthetic oligonucleotide
  modified_base (20)..(21): 2'-methoxy-nucleotide
gugggacaggcaccucagauu

SEQ ID NO: 3388 - RNA, 21 nt, Artificial Sequence
  Description of Artificial Sequence: Synthetic oligonucleotide
  modified_base (20)..(21): 2'-methoxy-nucleotide
ggugggacaggcaccucaguu

SEQ ID NO: 3389 - RNA, 21 nt, Artificial Sequence
  Description of Artificial Sequence: Synthetic oligonucleotide
  modified_base (20)..(21): 2'-methoxy-nucleotide
gggugggacaggcaccucauu

SEQ ID NO: 3390 - RNA, 21 nt, Artificial Sequence
  Description of Artificial Sequence: Synthetic oligonucleotide
  modified_base (20)..(21): 2'-methoxy-nucleotide
ggggugggacaggcaccucuu

SEQ ID NO: 3391 - RNA, 21 nt, Artificial Sequence
  Description of Artificial Sequence: Synthetic oligonucleotide
  modified_base (20)..(21): 2'-methoxy-nucleotide
gggggugggacaggcaccuuu

SEQ ID NO: 3392 - RNA, 21 nt, Artificial Sequence
  Description of Artificial Sequence: Synthetic oligonucleotide
  modified_base (20)..(21): 2'-methoxy-nucleotide
ugggggugggacaggcaccuu

SEQ ID NO: 3393 - RNA, 21 nt, Artificial Sequence
  Description of Artificial Sequence: Synthetic oligonucleotide
  modified_base (20)..(21): 2'-methoxy-nucleotide
gugggggugggacaggcacuu

SEQ ID NO: 3394 - RNA, 21 nt, Artificial Sequence
  Description of Artificial Sequence: Synthetic oligonucleotide
  modified_base (20)..(21): 2'-methoxy-nucleotide
ggugggggugggacaggcauu

SEQ ID NO: 3395 - RNA, 21 nt, Artificial Sequence
  Description of Artificial Sequence: Synthetic oligonucleotide
  modified_base (20)..(21): 2'-methoxy-nucleotide
gggugggggugggacaggcuu

SEQ ID NO: 3396 - RNA, 21 nt, Artificial Sequence
  Description of Artificial Sequence: Synthetic oligonucleotide
  modified_base (20)..(21): 2'-methoxy-nucleotide
ggggugggggugggacagguu

SEQ ID NO: 3397 - RNA, 21 nt, Artificial Sequence
  Description of Artificial Sequence: Synthetic oligonucleotide
  modified_base (20)..(21): 2'-methoxy-nucleotide
gggggugggggugggacaguu

SEQ ID NO: 3398 - RNA, 21 nt, Artificial Sequence
  Description of Artificial Sequence: Synthetic oligonucleotide
  modified_base (20)..(21): 2'-methoxy-nucleotide
ugggggugggggugggacauu

SEQ ID NO: 3399 - RNA, 21 nt, Artificial Sequence
  Description of Artificial Sequence: Synthetic oligonucleotide
  modified_base (20)..(21): 2'-methoxy-nucleotide
cugggggugggggugggacuu

SEQ ID NO: 3400 - RNA, 21 nt, Artificial Sequence
  Description of Artificial Sequence: Synthetic oligonucleotide
  modified_base (20)..(21): 2'-methoxy-nucleotide
gcugggggugggggugggauu

SEQ ID NO: 3401 - RNA, 21 nt, Artificial Sequence
  Description of Artificial Sequence: Synthetic oligonucleotide
  modified_base (20)..(21): 2'-methoxy-nucleotide
agcuggggguggggguggguu

SEQ ID NO: 3402 - RNA, 21 nt, Artificial Sequence
  Description of Artificial Sequence: Synthetic oligonucleotide
  modified_base (20)..(21): 2'-methoxy-nucleotide
gagcugggggugggggugguu

SEQ ID NO: 3403 - RNA, 21 nt, Artificial Sequence
  Description of Artificial Sequence: Synthetic oligonucleotide
  modified_base (20)..(21): 2'-methoxy-nucleotide
ugagcuggggguggggguguu

SEQ ID NO: 3404 - RNA, 21 nt, Artificial Sequence
  Description of Artificial Sequence: Synthetic oligonucleotide
  modified_base (20)..(21): 2'-methoxy-nucleotide
uugagcuggggguggggguuu

SEQ ID NO: 3405 - RNA, 21 nt, Artificial Sequence
  Description of Artificial Sequence: Synthetic oligonucleotide
  modified_base (20)..(21): 2'-methoxy-nucleotide
auugagcuggggguggggguu

SEQ ID NO: 3406 - RNA, 21 nt, Artificial Sequence
  Description of Artificial Sequence: Synthetic oligonucleotide
  modified_base (20)..(21): 2'-methoxy-nucleotide
cauugagcugggggugggguu

SEQ ID NO: 3407 - RNA, 21 nt, Artificial Sequence
  Description of Artificial Sequence: Synthetic oligonucleotide
  modified_base (20)..(21): 2'-methoxy-nucleotide
ccauugagcuggggguggguu

SEQ ID NO: 3408 - RNA, 21 nt, Artificial Sequence
  Description of Artificial Sequence: Synthetic oligonucleotide
  modified_base (20)..(21): 2'-methoxy-nucleotide
uccauugagcugggggugguu

SEQ ID NO: 3409 - RNA, 21 nt, Artificial Sequence
  Description of Artificial Sequence: Synthetic oligonucleotide
  modified_base (20)..(21): 2'-methoxy-nucleotide
guccauugagcuggggguguu

SEQ ID NO: 3410 - RNA, 21 nt, Artificial Sequence
  Description of Artificial Sequence: Synthetic oligonucleotide
  modified_base (20)..(21): 2'-methoxy-nucleotide
aguccauugagcuggggguuu

SEQ ID NO: 3411 - RNA, 21 nt, Artificial Sequence
  Description of Artificial Sequence: Synthetic oligonucleotide
  modified_base (20)..(21): 2'-methoxy-nucleotide
caguccauugagcuggggguu

SEQ ID NO: 3412 - RNA, 21 nt, Artificial Sequence
  Description of Artificial Sequence: Synthetic oligonucleotide
  modified_base (20)..(21): 2'-methoxy-nucleotide
ccaguccauugagcugggguu

SEQ ID NO: 3413 - RNA, 21 nt, Artificial Sequence
  Description of Artificial Sequence: Synthetic oligonucleotide
  modified_base (20)..(21): 2'-methoxy-nucleotide
uccaguccauugagcuggguu

SEQ ID NO: 3414 - RNA, 21 nt, Artificial Sequence
  Description of Artificial Sequence: Synthetic oligonucleotide
  modified_base (20)..(21): 2'-methoxy-nucleotide
uuccaguccauugagcugguu

SEQ ID NO: 3415 - RNA, 21 nt, Artificial Sequence
  Description of Artificial Sequence: Synthetic oligonucleotide
  modified_base (20)..(21): 2'-methoxy-nucleotide
cuuccaguccauugagcuguu

SEQ ID NO: 3416 - RNA, 21 nt, Artificial Sequence
  Description of Artificial Sequence: Synthetic oligonucleotide
  modified_base (20)..(21): 2'-methoxy-nucleotide
ccuuccaguccauugagcuuu

SEQ ID NO: 3417 - RNA, 21 nt, Artificial Sequence
  Description of Artificial Sequence: Synthetic oligonucleotide
  modified_base (20)..(21): 2'-methoxy-nucleotide
cccuuccaguccauugagcuu

SEQ ID NO: 3418 - RNA, 21 nt, Artificial Sequence
  Description of Artificial Sequence: Synthetic oligonucleotide
  modified_base (20)..(21): 2'-methoxy-nucleotide
ccccuuccaguccauugaguu

SEQ ID NO: 3419 - RNA, 21 nt, Artificial Sequence
  Description of Artificial Sequence: Synthetic oligonucleotide
  modified_base (20)..(21): 2'-methoxy-nucleotide
uccccuuccaguccauugauu

SEQ ID NO: 3420 - RNA, 21 nt, Artificial Sequence
  Description of Artificial Sequence: Synthetic oligonucleotide
  modified_base (20)..(21): 2'-methoxy-nucleotide
uuccccuuccaguccauuguu

SEQ ID NO: 3421 - RNA, 21 nt, Artificial Sequence
  Description of Artificial Sequence: Synthetic oligonucleotide
  modified_base (20)..(21): 2'-methoxy-nucleotide
cuuccccuuccaguccauuuu

SEQ ID NO: 3422 - RNA, 21 nt, Artificial Sequence
  Description of Artificial Sequence: Synthetic oligonucleotide
  modified_base (20)..(21): 2'-methoxy-nucleotide
ccuuccccuuccaguccauuu

SEQ ID NO: 3423 - RNA, 21 nt, Artificial Sequence
  Description of Artificial Sequence: Synthetic oligonucleotide
  modified_base (20)..(21): 2'-methoxy-nucleotide
cccuuccccuuccaguccauu

SEQ ID NO: 3424 - RNA, 21 nt, Artificial Sequence
  Description of Artificial Sequence: Synthetic oligonucleotide
  modified_base (20)..(21): 2'-methoxy-nucleotide
ucccuuccccuuccaguccuu

SEQ ID NO: 3425 - RNA, 21 nt, Artificial Sequence
  Description of Artificial Sequence: Synthetic oligonucleotide
  modified_base (20)..(21): 2'-methoxy-nucleotide
gucccuuccccuuccagucuu

SEQ ID NO: 3426 - RNA, 21 nt, Artificial Sequence
  Description of Artificial Sequence: Synthetic oligonucleotide
  modified_base (20)..(21): 2'-methoxy-nucleotide
ugucccuuccccuuccaguuu

SEQ ID NO: 3427 - RNA, 21 nt, Artificial Sequence
  Description of Artificial Sequence: Synthetic oligonucleotide
  modified_base (20)..(21): 2'-methoxy-nucleotide
gugucccuuccccuuccaguu

SEQ ID NO: 3428 - RNA, 21 nt, Artificial Sequence
  Description of Artificial Sequence: Synthetic oligonucleotide
  modified_base (20)..(21): 2'-methoxy-nucleotide
ugugucccuuccccuuccauu

SEQ ID NO: 3429 - RNA, 21 nt, Artificial Sequence
  Description of Artificial Sequence: Synthetic oligonucleotide
  modified_base (20)..(21): 2'-methoxy-nucleotide
gugugucccuuccccuuccuu

SEQ ID NO: 3430 - RNA, 21 nt, Artificial Sequence
  Description of Artificial Sequence: Synthetic oligonucleotide
  modified_base (20)..(21): 2'-methoxy-nucleotide
ugugugucccuuccccuucuu

SEQ ID NO: 3431 - RNA, 21 nt, Artificial Sequence
  Description of Artificial Sequence: Synthetic oligonucleotide
  modified_base (20)..(21): 2'-methoxy-nucleotide
uugugugucccuuccccuuuu

SEQ ID NO: 3432 - RNA, 21 nt, Artificial Sequence
  Description of Artificial Sequence: Synthetic oligonucleotide
  modified_base (20)..(21): 2'-methoxy-nucleotide
cuugugugucccuuccccuuu

SEQ ID NO: 3433 - RNA, 21 nt, Artificial Sequence
  Description of Artificial Sequence: Synthetic oligonucleotide
  modified_base (20)..(21): 2'-methoxy-nucleotide
ucuugugugucccuuccccuu

SEQ ID NO: 3434 - RNA, 21 nt, Artificial Sequence
  Description of Artificial Sequence: Synthetic oligonucleotide
  modified_base (20)..(21): 2'-methoxy-nucleotide
uucuugugugucccuucccuu

SEQ ID NO: 3435 - RNA, 21 nt, Artificial Sequence
  Description of Artificial Sequence: Synthetic oligonucleotide
  modified_base (20)..(21): 2'-methoxy-nucleotide
cuucuugugugucccuuccuu

SEQ ID NO: 3436 - RNA, 21 nt, Artificial Sequence
  Description of Artificial Sequence: Synthetic oligonucleotide
  modified_base (20)..(21): 2'-methoxy-nucleotide
ucuucuugugugucccuucuu

SEQ ID NO: 3437 - RNA, 21 nt, Artificial Sequence
  Description of Artificial Sequence: Synthetic oligonucleotide
  modified_base (20)..(21): 2'-methoxy-nucleotide
uucuucuugugugucccuuuu

SEQ ID NO: 3438 - RNA, 21 nt, Artificial Sequence
  Description of Artificial Sequence: Synthetic oligonucleotide
  modified_base (20)..(21): 2'-methoxy-nucleotide
cuucuucuugugugucccuuu

SEQ ID NO: 3439 - RNA, 21 nt, Artificial Sequence
  Description of Artificial Sequence: Synthetic oligonucleotide
  modified_base (20)..(21): 2'-methoxy-nucleotide
ccuucuucuugugugucccuu

SEQ ID NO: 3440 - RNA, 21 nt, Artificial Sequence
  Description of Artificial Sequence: Synthetic oligonucleotide
  modified_base (20)..(21): 2'-methoxy-nucleotide
cccuucuucuuguguguccuu

SEQ ID NO: 3441 - RNA, 21 nt, Artificial Sequence
  Description of Artificial Sequence: Synthetic oligonucleotide
  modified_base (20)..(21): 2'-methoxy-nucleotide
gcccuucuucuugugugucuu

SEQ ID NO: 3442 - RNA, 21 nt, Artificial Sequence
  Description of Artificial Sequence: Synthetic oligonucleotide
  modified_base (20)..(21): 2'-methoxy-nucleotide
ugcccuucuucuuguguguuu

SEQ ID NO: 3443 - RNA, 21 nt, Artificial Sequence
  Description of Artificial Sequence: Synthetic oligonucleotide
  modified_base (20)..(21): 2'-methoxy-nucleotide
gugcccuucuucuuguguguu

SEQ ID NO: 3444 - RNA, 21 nt, Artificial Sequence
  Description of Artificial Sequence: Synthetic oligonucleotide
  modified_base (20)..(21): 2'-methoxy-nucleotide
ggugcccuucuucuuguguuu

SEQ ID NO: 3445 - RNA, 21 nt, Artificial Sequence
  Description of Artificial Sequence: Synthetic oligonucleotide
  modified_base (20)..(21): 2'-methoxy-nucleotide
gggugcccuucuucuuguguu

SEQ ID NO: 3446 - RNA, 21 nt, Artificial Sequence
  Description of Artificial Sequence: Synthetic oligonucleotide
  modified_base (20)..(21): 2'-methoxy-nucleotide
agggugcccuucuucuuguuu

SEQ ID NO: 3447 - RNA, 21 nt, Artificial Sequence
  Description of Artificial Sequence: Synthetic oligonucleotide
  modified_base (20)..(21): 2'-methoxy-nucleotide
uagggugcccuucuucuuguu

SEQ ID NO: 3448 - RNA, 21 nt, Artificial Sequence
  Description of Artificial Sequence: Synthetic oligonucleotide
  modified_base (20)..(21): 2'-methoxy-nucleotide
cuagggugcccuucuucuuuu

SEQ ID NO: 3449 - RNA, 21 nt, Artificial Sequence
  Description of Artificial Sequence: Synthetic oligonucleotide
  modified_base (20)..(21): 2'-methoxy-nucleotide
acuagggugcccuucuucuuu

SEQ ID NO: 3450 - RNA, 21 nt, Artificial Sequence
  Description of Artificial Sequence: Synthetic oligonucleotide
  modified_base (20)..(21): 2'-methoxy-nucleotide
aacuagggugcccuucuucuu

SEQ ID NO: 3451 - RNA, 21 nt, Artificial Sequence
  Description of Artificial Sequence: Synthetic oligonucleotide
  modified_base (20)..(21): 2'-methoxy-nucleotide
gaacuagggugcccuucuuuu

SEQ ID NO: 3452 - RNA, 21 nt, Artificial Sequence
  Description of Artificial Sequence: Synthetic oligonucleotide
  modified_base (20)..(21): 2'-methoxy-nucleotide
agaacuagggugcccuucuuu

SEQ ID NO: 3453 - RNA, 21 nt, Artificial Sequence
  Description of Artificial Sequence: Synthetic oligonucleotide
  modified_base (20)..(21): 2'-methoxy-nucleotide
uagaacuagggugcccuucuu

SEQ ID NO: 3454 - RNA, 21 nt, Artificial Sequence
  Description of Artificial Sequence: Synthetic oligonucleotide
  modified_base (20)..(21): 2'-methoxy-nucleotide
guagaacuagggugcccuuuu

SEQ ID NO: 3455 - RNA, 21 nt, Artificial Sequence
  Description of Artificial Sequence: Synthetic oligonucleotide
  modified_base (20)..(21): 2'-methoxy-nucleotide
gguagaacuagggugcccuuu

SEQ ID NO: 3456 - RNA, 21 nt, Artificial Sequence
  Description of Artificial Sequence: Synthetic oligonucleotide
  modified_base (20)..(21): 2'-methoxy-nucleotide
agguagaacuagggugcccuu

SEQ ID NO: 3457 - RNA, 21 nt, Artificial Sequence
  Description of Artificial Sequence: Synthetic oligonucleotide
  modified_base (20)..(21): 2'-methoxy-nucleotide
gagguagaacuagggugccuu

SEQ ID NO: 3458 - RNA, 21 nt, Artificial Sequence
  Description of Artificial Sequence: Synthetic oligonucleotide
  modified_base (20)..(21): 2'-methoxy-nucleotide
ugagguagaacuagggugcuu

SEQ ID NO: 3459 - RNA, 21 nt, Artificial Sequence
  Description of Artificial Sequence: Synthetic oligonucleotide
  modified_base (20)..(21): 2'-methoxy-nucleotide
cugagguagaacuaggguguu

SEQ ID NO: 3460 - RNA, 21 nt, Artificial Sequence
  Description of Artificial Sequence: Synthetic oligonucleotide
  modified_base (20)..(21): 2'-methoxy-nucleotide
ccugagguagaacuaggguuu

SEQ ID NO: 3461 - RNA, 21 nt, Artificial Sequence
  Description of Artificial Sequence: Synthetic oligonucleotide
  modified_base (20)..(21): 2'-methoxy-nucleotide
gccugagguagaacuaggguu

SEQ ID NO: 3462 - RNA, 21 nt, Artificial Sequence
  Description of Artificial Sequence: Synthetic oligonucleotide
  modified_base (20)..(21): 2'-methoxy-nucleotide
ugccugagguagaacuagguu

SEQ ID NO: 3463 - RNA, 21 nt, Artificial Sequence
  Description of Artificial Sequence: Synthetic oligonucleotide
  modified_base (20)..(21): 2'-methoxy-nucleotide
cugccugagguagaacuaguu

SEQ ID NO: 3464 - RNA, 21 nt, Artificial Sequence
  Description of Artificial Sequence: Synthetic oligonucleotide
  modified_base (20)..(21): 2'-methoxy-nucleotide
gcugccugagguagaacuauu

SEQ ID NO: 3465 - RNA, 21 nt, Artificial Sequence
  Description of Artificial Sequence: Synthetic oligonucleotide
  modified_base (20)..(21): 2'-methoxy-nucleotide
agcugccugagguagaacuuu

SEQ ID NO: 3466 - RNA, 21 nt, Artificial Sequence
  Description of Artificial Sequence: Synthetic oligonucleotide
  modified_base (20)..(21): 2'-methoxy-nucleotide
gagcugccugagguagaacuu

SEQ ID NO: 3467 - RNA, 21 nt, Artificial Sequence
  Description of Artificial Sequence: Synthetic oligonucleotide
  modified_base (20)..(21): 2'-methoxy-nucleotide
ugagcugccugagguagaauu

SEQ ID NO: 3468 - RNA, 21 nt, Artificial Sequence
  Description of Artificial Sequence: Synthetic oligonucleotide
  modified_base (20)..(21): 2'-methoxy-nucleotide
uugagcugccugagguagauu

SEQ ID NO: 3469 - RNA, 21 nt, Artificial Sequence
  Description of Artificial Sequence: Synthetic oligonucleotide
  modified_base (20)..(21): 2'-methoxy-nucleotide
cuugagcugccugagguaguu

SEQ ID NO: 3470 - RNA, 21 nt, Artificial Sequence
  Description of Artificial Sequence: Synthetic oligonucleotide
  modified_base (20)..(21): 2'-methoxy-nucleotide
gcuugagcugccugagguauu

SEQ ID NO: 3471 - RNA, 21 nt, Artificial Sequence
  Description of Artificial Sequence: Synthetic oligonucleotide
  modified_base (20)..(21): 2'-methoxy-nucleotide
ugcuugagcugccugagguuu

SEQ ID NO: 3472 - RNA, 21 nt, Artificial Sequence
  Description of Artificial Sequence: Synthetic oligonucleotide
  modified_base (20)..(21): 2'-methoxy-nucleotide
cugcuugagcugccugagguu

SEQ ID NO: 3473 - RNA, 21 nt, Artificial Sequence
  Description of Artificial Sequence: Synthetic oligonucleotide
  modified_base (20)..(21): 2'-methoxy-nucleotide
gcugcuugagcugccugaguu

SEQ ID NO: 3474 - RNA, 21 nt, Artificial Sequence
  Description of Artificial Sequence: Synthetic oligonucleotide
  modified_base (20)..(21): 2'-methoxy-nucleotide
cgcugcuugagcugccugauu

SEQ ID NO: 3475 - RNA, 21 nt, Artificial Sequence
  Description of Artificial Sequence: Synthetic oligonucleotide
  modified_base (20)..(21): 2'-methoxy-nucleotide
ucgcugcuugagcugccuguu

SEQ ID NO: 3476 - RNA, 21 nt, Artificial Sequence
  Description of Artificial Sequence: Synthetic oligonucleotide
  modified_base (20)..(21): 2'-methoxy-nucleotide
gucgcugcuugagcugccuuu

SEQ ID NO: 3477 - RNA, 21 nt, Artificial Sequence
  Description of Artificial Sequence: Synthetic oligonucleotide
  modified_base (20)..(21): 2'-methoxy-nucleotide
ggucgcugcuugagcugccuu

SEQ ID NO: 3478 - RNA, 21 nt, Artificial Sequence
  Description of Artificial Sequence: Synthetic oligonucleotide
  modified_base (20)..(21): 2'-methoxy-nucleotide
cggucgcugcuugagcugcuu

SEQ ID NO: 3479 - RNA, 21 nt, Artificial Sequence
  Description of Artificial Sequence: Synthetic oligonucleotide
  modified_base (20)..(21): 2'-methoxy-nucleotide
gcggucgcugcuugagcuguu

SEQ ID NO: 3480 - RNA, 21 nt, Artificial Sequence
  Description of Artificial Sequence: Synthetic oligonucleotide
  modified_base (20)..(21): 2'-methoxy-nucleotide
ggcggucgcugcuugagcuuu

SEQ ID NO: 3481 - RNA, 21 nt, Artificial Sequence
  Description of Artificial Sequence: Synthetic oligonucleotide
  modified_base (20)..(21): 2'-methoxy-nucleotide
gggcggucgcugcuugagcuu

SEQ ID NO: 3482 - RNA, 21 nt, Artificial Sequence
  Description of Artificial Sequence: Synthetic oligonucleotide
  modified_base (20)..(21): 2'-methoxy-nucleotide
ggggcggucgcugcuugaguu

SEQ ID NO: 3483 - RNA, 21 nt, Artificial Sequence
  Description of Artificial Sequence: Synthetic oligonucleotide
  modified_base (20)..(21): 2'-methoxy-nucleotide
gggggcggucgcugcuugauu

SEQ ID NO: 3484 - RNA, 21 nt, Artificial Sequence
  Description of Artificial Sequence: Synthetic oligonucleotide
  modified_base (20)..(21): 2'-methoxy-nucleotide
agggggcggucgcugcuuguu

SEQ ID NO: 3485 - RNA, 21 nt, Artificial Sequence
  Description of Artificial Sequence: Synthetic oligonucleotide
  modified_base (20)..(21): 2'-methoxy-nucleotide
gagggggcggucgcugcuuuu

SEQ ID NO: 3486 - RNA, 21 nt, Artificial Sequence
  Description of Artificial Sequence: Synthetic oligonucleotide
  modified_base (20)..(21): 2'-methoxy-nucleotide
ggagggggcggucgcugcuuu

SEQ ID NO: 3487 - RNA, 21 nt, Artificial Sequence
  Description of Artificial Sequence: Synthetic oligonucleotide
  modified_base (20)..(21): 2'-methoxy-nucleotide
aggagggggcggucgcugcuu

SEQ ID NO: 3488 - RNA, 21 nt, Artificial Sequence
  Description of Artificial Sequence: Synthetic oligonucleotide
  modified_base (20)..(21): 2'-methoxy-nucleotide
gaggagggggcggucgcuguu

SEQ ID NO: 3489 - RNA, 21 nt, Artificial Sequence
  Description of Artificial Sequence: Synthetic oligonucleotide
  modified_base (20)..(21): 2'-methoxy-nucleotide
agaggagggggcggucgcuuu

SEQ ID NO: 3490 - RNA, 21 nt, Artificial Sequence
  Description of Artificial Sequence: Synthetic oligonucleotide
  modified_base (20)..(21): 2'-methoxy-nucleotide
uagaggagggggcggucgcuu

SEQ ID NO: 3491 - RNA, 21 nt, Artificial Sequence
  Description of Artificial Sequence: Synthetic oligonucleotide
  modified_base (20)..(21): 2'-methoxy-nucleotide
cuagaggagggggcggucguu

SEQ ID NO: 3492 - RNA, 21 nt, Artificial Sequence
  Description of Artificial Sequence: Synthetic oligonucleotide
  modified_base (20)..(21): 2'-methoxy-nucleotide
gcuagaggagggggcggucuu

SEQ ID NO: 3493 - RNA, 21 nt, Artificial Sequence
  Description of Artificial Sequence: Synthetic oligonucleotide
  modified_base (20)..(21): 2'-methoxy-nucleotide
agcuagaggagggggcgguuu

SEQ ID NO: 3494 - RNA, 21 nt, Artificial Sequence
  Description of Artificial Sequence: Synthetic oligonucleotide
  modified_base (20)..(21): 2'-methoxy-nucleotide
cagcuagaggagggggcgguu

SEQ ID NO: 3495 - RNA, 21 nt, Artificial Sequence
  Description of Artificial Sequence: Synthetic oligonucleotide
  modified_base (20)..(21): 2'-methoxy-nucleotide
acagcuagaggagggggcguu

SEQ ID NO: 3496 - RNA, 21 nt, Artificial Sequence
  Description of Artificial Sequence: Synthetic oligonucleotide
  modified_base (20)..(21): 2'-methoxy-nucleotide
cacagcuagaggagggggcuu

SEQ ID NO: 3497 - RNA, 21 nt, Artificial Sequence
  Description of Artificial Sequence: Synthetic oligonucleotide
  modified_base (20)..(21): 2'-methoxy-nucleotide
ccacagcuagaggaggggguu

SEQ ID NO: 3498 - RNA, 21 nt, Artificial Sequence
  Description of Artificial Sequence: Synthetic oligonucleotide
  modified_base (20)..(21): 2'-methoxy-nucleotide
cccacagcuagaggagggguu

SEQ ID NO: 3499 - RNA, 21 nt, Artificial Sequence
  Description of Artificial Sequence: Synthetic oligonucleotide
  modified_base (20)..(21): 2'-methoxy-nucleotide
ccccacagcuagaggaggguu

SEQ ID NO: 3500 - RNA, 21 nt, Artificial Sequence
  Description of Artificial Sequence: Synthetic oligonucleotide
  modified_base (20)..(21): 2'-methoxy-nucleotide
cccccacagcuagaggagguu

SEQ ID NO: 3501 - RNA, 21 nt, Artificial Sequence
  Description of Artificial Sequence: Synthetic oligonucleotide
  modified_base (20)..(21): 2'-methoxy-nucleotide
acccccacagcuagaggaguu

SEQ ID NO: 3502 - RNA, 21 nt, Artificial Sequence
  Description of Artificial Sequence: Synthetic oligonucleotide
  modified_base (20)..(21): 2'-methoxy-nucleotide
cacccccacagcuagaggauu

SEQ ID NO: 3503 - RNA, 21 nt, Artificial Sequence
  Description of Artificial Sequence: Synthetic oligonucleotide
  modified_base (20)..(21): 2'-methoxy-nucleotide
ucacccccacagcuagagguu

SEQ ID NO: 3504 - RNA, 21 nt, Artificial Sequence
  Description of Artificial Sequence: Synthetic oligonucleotide
  modified_base (20)..(21): 2'-methoxy-nucleotide
cucacccccacagcuagaguu

SEQ ID NO: 3505 - RNA, 21 nt, Artificial Sequence
  Description of Artificial Sequence: Synthetic oligonucleotide
  modified_base (20)..(21): 2'-methoxy-nucleotide
ccucacccccacagcuagauu

SEQ ID NO: 3506 - RNA, 21 nt, Artificial Sequence
  Description of Artificial Sequence: Synthetic oligonucleotide
  modified_base (20)..(21): 2'-methoxy-nucleotide
cccucacccccacagcuaguu

SEQ ID NO: 3507 - RNA, 21 nt, Artificial Sequence
  Description of Artificial Sequence: Synthetic oligonucleotide
  modified_base (20)..(21): 2'-methoxy-nucleotide
acccucacccccacagcuauu

SEQ ID NO: 3508 - RNA, 21 nt, Artificial Sequence
  Description of Artificial Sequence: Synthetic oligonucleotide
  modified_base (20)..(21): 2'-methoxy-nucleotide
gacccucacccccacagcuuu

SEQ ID NO: 3509 - RNA, 21 nt, Artificial Sequence
  Description of Artificial Sequence: Synthetic oligonucleotide
  modified_base (20)..(21): 2'-methoxy-nucleotide
ggacccucacccccacagcuu

SEQ ID NO: 3510 - RNA, 21 nt, Artificial Sequence
  Description of Artificial Sequence: Synthetic oligonucleotide
  modified_base (20)..(21): 2'-methoxy-nucleotide
gggacccucacccccacaguu

SEQ ID NO: 3511 - RNA, 21 nt, Artificial Sequence
  Description of Artificial Sequence: Synthetic oligonucleotide
  modified_base (20)..(21): 2'-methoxy-nucleotide
ugggacccucacccccacauu

SEQ ID NO: 3512 - RNA, 21 nt, Artificial Sequence
  Description of Artificial Sequence: Synthetic oligonucleotide
  modified_base (20)..(21): 2'-methoxy-nucleotide
augggacccucacccccacuu

SEQ ID NO: 3513 - RNA, 21 nt, Artificial Sequence
  Description of Artificial Sequence: Synthetic oligonucleotide
  modified_base (20)..(21): 2'-methoxy-nucleotide
caugggacccucacccccauu

SEQ ID NO: 3514 - RNA, 21 nt, Artificial Sequence
  Description of Artificial Sequence: Synthetic oligonucleotide
  modified_base (20)..(21): 2'-methoxy-nucleotide
acaugggacccucacccccuu

SEQ ID NO: 3515 - RNA, 21 nt, Artificial Sequence
  Description of Artificial Sequence: Synthetic oligonucleotide
  modified_base (20)..(21): 2'-methoxy-nucleotide
cacaugggacccucaccccuu

SEQ ID NO: 3516 - RNA, 21 nt, Artificial Sequence
  Description of Artificial Sequence: Synthetic oligonucleotide
  modified_base (20)..(21): 2'-methoxy-nucleotide
ccacaugggacccucacccuu

SEQ ID NO: 3517 - RNA, 21 nt, Artificial Sequence
  Description of Artificial Sequence: Synthetic oligonucleotide
  modified_base (20)..(21): 2'-methoxy-nucleotide
accacaugggacccucaccuu

SEQ ID NO: 3518 - RNA, 21 nt, Artificial Sequence
  Description of Artificial Sequence: Synthetic oligonucleotide
  modified_base (20)..(21): 2'-methoxy-nucleotide
caccacaugggacccucacuu

SEQ ID NO: 3519 - RNA, 21 nt, Artificial Sequence
  Description of Artificial Sequence: Synthetic oligonucleotide
  modified_base (20)..(21): 2'-methoxy-nucleotide
ccaccacaugggacccucauu

SEQ ID NO: 3520 - RNA, 21 nt, Artificial Sequence
  Description of Artificial Sequence: Synthetic oligonucleotide
  modified_base (20)..(21): 2'-methoxy-nucleotide
gccaccacaugggacccucuu

SEQ ID NO: 3521 - RNA, 21 nt, Artificial Sequence
  Description of Artificial Sequence: Synthetic oligonucleotide
  modified_base (20)..(21): 2'-methoxy-nucleotide
ugccaccacaugggacccuuu

SEQ ID NO: 3522 - RNA, 21 nt, Artificial Sequence
  Description of Artificial Sequence: Synthetic oligonucleotide
  modified_base (20)..(21): 2'-methoxy-nucleotide
gugccaccacaugggacccuu

SEQ ID NO: 3523 - RNA, 21 nt, Artificial Sequence
  Description of Artificial Sequence: Synthetic oligonucleotide
  modified_base (20)..(21): 2'-methoxy-nucleotide
ugugccaccacaugggaccuu

SEQ ID NO: 3524 - RNA, 21 nt, Artificial Sequence
  Description of Artificial Sequence: Synthetic oligonucleotide
  modified_base (20)..(21): 2'-methoxy-nucleotide
cugugccaccacaugggacuu

SEQ ID NO: 3525 - RNA, 21 nt, Artificial Sequence
  Description of Artificial Sequence: Synthetic oligonucleotide
  modified_base (20)..(21): 2'-methoxy-nucleotide
ccugugccaccacaugggauu

SEQ ID NO: 3526 - RNA, 21 nt, Artificial Sequence
  Description of Artificial Sequence: Synthetic oligonucleotide
  modified_base (20)..(21): 2'-methoxy-nucleotide
gccugugccaccacauggguu

SEQ ID NO: 3527 - RNA, 21 nt, Artificial Sequence
  Description of Artificial Sequence: Synthetic oligonucleotide
  modified_base (20)..(21): 2'-methoxy-nucleotide
ggccugugccaccacaugguu

SEQ ID NO: 3528 - RNA, 21 nt, Artificial Sequence
  Description of Artificial Sequence: Synthetic oligonucleotide
  modified_base (20)..(21): 2'-methoxy-nucleotide
gggccugugccaccacauguu

SEQ ID NO: 3529 - RNA, 21 nt, Artificial Sequence
  Description of Artificial Sequence: Synthetic oligonucleotide
  modified_base (20)..(21): 2'-methoxy-nucleotide
ggggccugugccaccacauuu

SEQ ID NO: 3530 - RNA, 21 nt, Artificial Sequence
  Description of Artificial Sequence: Synthetic oligonucleotide
  modified_base (20)..(21): 2'-methoxy-nucleotide
gggggccugugccaccacauu

SEQ ID NO: 3531 - RNA, 21 nt, Artificial Sequence
  Description of Artificial Sequence: Synthetic oligonucleotide
  modified_base (20)..(21): 2'-methoxy-nucleotide
agggggccugugccaccacuu

SEQ ID NO: 3532 - RNA, 21 nt, Artificial Sequence
  Description of Artificial Sequence: Synthetic oligonucleotide
  modified_base (20)..(21): 2'-methoxy-nucleotide
aagggggccugugccaccauu

SEQ ID NO: 3533 - RNA, 21 nt, Artificial Sequence
  Description of Artificial Sequence: Synthetic oligonucleotide
  modified_base (20)..(21): 2'-methoxy-nucleotide
caagggggccugugccaccuu

SEQ ID NO: 3534 - RNA, 21 nt, Artificial Sequence
  Description of Artificial Sequence: Synthetic oligonucleotide
  modified_base (20)..(21): 2'-methoxy-nucleotide
ucaagggggccugugccacuu

SEQ ID NO: 3535 - RNA, 21 nt, Artificial Sequence
  Description of Artificial Sequence: Synthetic oligonucleotide
  modified_base (20)..(21): 2'-methoxy-nucleotide
cucaagggggccugugccauu

SEQ ID NO: 3536 - RNA, 21 nt, Artificial Sequence
  Description of Artificial Sequence: Synthetic oligonucleotide
  modified_base (20)..(21): 2'-methoxy-nucleotide
acucaagggggccugugccuu

SEQ ID NO: 3537 - RNA, 21 nt, Artificial Sequence
  Description of Artificial Sequence: Synthetic oligonucleotide
  modified_base (20)..(21): 2'-methoxy-nucleotide
cacucaagggggccugugcuu

SEQ ID NO: 3538 - RNA, 21 nt, Artificial Sequence
  Description of Artificial Sequence: Synthetic oligonucleotide
  modified_base (20)..(21): 2'-methoxy-nucleotide
ccacucaagggggccuguguu

SEQ ID NO: 3539 - RNA, 21 nt, Artificial Sequence
  Description of Artificial Sequence: Synthetic oligonucleotide
  modified_base (20)..(21): 2'-methoxy-nucleotide
cccacucaagggggccuguuu

SEQ ID NO: 3540 - RNA, 21 nt, Artificial Sequence
  Description of Artificial Sequence: Synthetic oligonucleotide
  modified_base (20)..(21): 2'-methoxy-nucleotide
ccccacucaagggggccuguu

SEQ ID NO: 3541 - RNA, 21 nt, Artificial Sequence
  Description of Artificial Sequence: Synthetic oligonucleotide
  modified_base (20)..(21): 2'-methoxy-nucleotide
accccacucaagggggccuuu

SEQ ID NO: 3542 - RNA, 21 nt, Artificial Sequence
  Description of Artificial Sequence: Synthetic oligonucleotide
  modified_base (20)..(21): 2'-methoxy-nucleotide
aaccccacucaagggggccuu

SEQ ID NO: 3543 - RNA, 21 nt, Artificial Sequence
  Description of Artificial Sequence: Synthetic oligonucleotide
  modified_base (20)..(21): 2'-methoxy-nucleotide
uaaccccacucaagggggcuu

SEQ ID NO: 3544 - RNA, 21 nt, Artificial Sequence
  Description of Artificial Sequence: Synthetic oligonucleotide
  modified_base (20)..(21): 2'-methoxy-nucleotide
auaaccccacucaaggggguu

SEQ ID NO: 3545 - RNA, 21 nt, Artificial Sequence
  Description of Artificial Sequence: Synthetic oligonucleotide
  modified_base (20)..(21): 2'-methoxy-nucleotide
gauaaccccacucaagggguu

SEQ ID NO: 3546 - RNA, 21 nt, Artificial Sequence
  Description of Artificial Sequence: Synthetic oligonucleotide
  modified_base (20)..(21): 2'-methoxy-nucleotide
agauaaccccacucaaggguu

SEQ ID NO: 3547 - RNA, 21 nt, Artificial Sequence
  Description of Artificial Sequence: Synthetic oligonucleotide
  modified_base (20)..(21): 2'-methoxy-nucleotide
gagauaaccccacucaagguu

SEQ ID NO: 3548 - RNA, 21 nt, Artificial Sequence
  Description of Artificial Sequence: Synthetic oligonucleotide
  modified_base (20)..(21): 2'-methoxy-nucleotide
agagauaaccccacucaaguu

SEQ ID NO: 3549 - RNA, 21 nt, Artificial Sequence
  Description of Artificial Sequence: Synthetic oligonucleotide
  modified_base (20)..(21): 2'-methoxy-nucleotide
cagagauaaccccacucaauu

SEQ ID NO: 3550 - RNA, 21 nt, Artificial Sequence
  Description of Artificial Sequence: Synthetic oligonucleotide
  modified_base (20)..(21): 2'-methoxy-nucleotide
acagagauaaccccacucauu

SEQ ID NO: 3551 - RNA, 21 nt, Artificial Sequence
  Description of Artificial Sequence: Synthetic oligonucleotide
  modified_base (20)..(21): 2'-methoxy-nucleotide
cacagagauaaccccacucuu

SEQ ID NO: 3552 - RNA, 21 nt, Artificial Sequence
  Description of Artificial Sequence: Synthetic oligonucleotide
  modified_base (20)..(21): 2'-methoxy-nucleotide
acacagagauaaccccacuuu

SEQ ID NO: 3553 - RNA, 21 nt, Artificial Sequence
  Description of Artificial Sequence: Synthetic oligonucleotide
  modified_base (20)..(21): 2'-methoxy-nucleotide
aacacagagauaaccccacuu

SEQ ID NO: 3554 - RNA, 21 nt, Artificial Sequence
  Description of Artificial Sequence: Synthetic oligonucleotide
  modified_base (20)..(21): 2'-methoxy-nucleotide
uaacacagagauaaccccauu

SEQ ID NO: 3555 - RNA, 21 nt, Artificial Sequence
  Description of Artificial Sequence: Synthetic oligonucleotide
  modified_base (20)..(21): 2'-methoxy-nucleotide
cuaacacagagauaaccccuu

SEQ ID NO: 3556 - RNA, 21 nt, Artificial Sequence
  Description of Artificial Sequence: Synthetic oligonucleotide
  modified_base (20)..(21): 2'-methoxy-nucleotide
ccuaacacagagauaacccuu

SEQ ID NO: 3557 - RNA, 21 nt, Artificial Sequence
  Description of Artificial Sequence: Synthetic oligonucleotide
  modified_base (20)..(21): 2'-methoxy-nucleotide
cccuaacacagagauaaccuu

SEQ ID NO: 3558 - RNA, 21 nt, Artificial Sequence
  Description of Artificial Sequence: Synthetic oligonucleotide
  modified_base (20)..(21): 2'-methoxy-nucleotide
ccccuaacacagagauaacuu

SEQ ID NO: 3559 - RNA, 21 nt, Artificial Sequence
  Description of Artificial Sequence: Synthetic oligonucleotide
  modified_base (20)..(21): 2'-methoxy-nucleotide
accccuaacacagagauaauu

SEQ ID NO: 3560 - RNA, 21 nt, Artificial Sequence
  Description of Artificial Sequence: Synthetic oligonucleotide
  modified_base (20)..(21): 2'-methoxy-nucleotide
uaccccuaacacagagauauu

SEQ ID NO: 3561 - RNA, 21 nt, Artificial Sequence
  Description of Artificial Sequence: Synthetic oligonucleotide
  modified_base (20)..(21): 2'-methoxy-nucleotide
auaccccuaacacagagauuu

SEQ ID NO: 3562 - RNA, 21 nt, Artificial Sequence
  Description of Artificial Sequence: Synthetic oligonucleotide
  modified_base (20)..(21): 2'-methoxy-nucleotide
uauaccccuaacacagagauu

SEQ ID NO: 3563 - RNA, 21 nt, Artificial Sequence
  Description of Artificial Sequence: Synthetic oligonucleotide
  modified_base (20)..(21): 2'-methoxy-nucleotide
auauaccccuaacacagaguu

SEQ ID NO: 3564 - RNA, 21 nt, Artificial Sequence
  Description of Artificial Sequence: Synthetic oligonucleotide
  modified_base (20)..(21): 2'-methoxy-nucleotide
cauauaccccuaacacagauu

SEQ ID NO: 3565 - RNA, 21 nt, Artificial Sequence
  Description of Artificial Sequence: Synthetic oligonucleotide
  modified_base (20)..(21): 2'-methoxy-nucleotide
ucauauaccccuaacacaguu

SEQ ID NO: 3566 - RNA, 21 nt, Artificial Sequence
  Description of Artificial Sequence: Synthetic oligonucleotide
  modified_base (20)..(21): 2'-methoxy-nucleotide
aucauauaccccuaacacauu

SEQ ID NO: 3567 - RNA, 21 nt, Artificial Sequence
  Description of Artificial Sequence: Synthetic oligonucleotide
  modified_base (20)..(21): 2'-methoxy-nucleotide
caucauauaccccuaacacuu

SEQ ID NO: 3568 - RNA, 21 nt, Artificial Sequence
  Description of Artificial Sequence: Synthetic oligonucleotide
  modified_base (20)..(21): 2'-methoxy-nucleotide
ccaucauauaccccuaacauu

SEQ ID NO: 3569 - RNA, 21 nt, Artificial Sequence
  Description of Artificial Sequence: Synthetic oligonucleotide
  modified_base (20)..(21): 2'-methoxy-nucleotide
cccaucauauaccccuaacuu

SEQ ID NO: 3570 - RNA, 21 nt, Artificial Sequence
  Description of Artificial Sequence: Synthetic oligonucleotide
  modified_base (20)..(21): 2'-methoxy-nucleotide
ccccaucauauaccccuaauu

SEQ ID NO: 3571 - RNA, 21 nt, Artificial Sequence
  Description of Artificial Sequence: Synthetic oligonucleotide
  modified_base (20)..(21): 2'-methoxy-nucleotide
cccccaucauauaccccuauu

SEQ ID NO: 3572 - RNA, 21 nt, Artificial Sequence
  Description of Artificial Sequence: Synthetic oligonucleotide
  modified_base (20)..(21): 2'-methoxy-nucleotide
ucccccaucauauaccccuuu

SEQ ID NO: 3573 - RNA, 21 nt, Artificial Sequence
  Description of Artificial Sequence: Synthetic oligonucleotide
  modified_base (20)..(21): 2'-methoxy-nucleotide
cucccccaucauauaccccuu

SEQ ID NO: 3574 - RNA, 21 nt, Artificial Sequence
  Description of Artificial Sequence: Synthetic oligonucleotide
  modified_base (20)..(21): 2'-methoxy-nucleotide
acucccccaucauauacccuu

SEQ ID NO: 3575 - RNA, 21 nt, Artificial Sequence
  Description of Artificial Sequence: Synthetic oligonucleotide
  modified_base (20)..(21): 2'-methoxy-nucleotide
uacucccccaucauauaccuu

SEQ ID NO: 3576 - RNA, 21 nt, Artificial Sequence
  Description of Artificial Sequence: Synthetic oligonucleotide
  modified_base (20)..(21): 2'-methoxy-nucleotide
cuacucccccaucauauacuu

SEQ ID NO: 3577 - RNA, 21 nt, Artificial Sequence
  Description of Artificial Sequence: Synthetic oligonucleotide
  modified_base (20)..(21): 2'-methoxy-nucleotide
ucuacucccccaucauauauu

SEQ ID NO: 3578 - RNA, 21 nt, Artificial Sequence
  Description of Artificial Sequence: Synthetic oligonucleotide
  modified_base (20)..(21): 2'-methoxy-nucleotide
aucuacucccccaucauauuu

SEQ ID NO: 3579 - RNA, 21 nt, Artificial Sequence
  Description of Artificial Sequence: Synthetic oligonucleotide
  modified_base (20)..(21): 2'-methoxy-nucleotide
gaucuacucccccaucauauu

SEQ ID NO: 3580 - RNA, 21 nt, Artificial Sequence
  Description of Artificial Sequence: Synthetic oligonucleotide
  modified_base (20)..(21): 2'-methoxy-nucleotide
agaucuacucccccaucauuu

SEQ ID NO: 3581 - RNA, 21 nt, Artificial Sequence
  Description of Artificial Sequence: Synthetic oligonucleotide
  modified_base (20)..(21): 2'-methoxy-nucleotide
aagaucuacucccccaucauu

SEQ ID NO: 3582 - RNA, 21 nt, Artificial Sequence
  Description of Artificial Sequence: Synthetic oligonucleotide
  modified_base (20)..(21): 2'-methoxy-nucleotide
aaagaucuacucccccaucuu

SEQ ID NO: 3583 - RNA, 21 nt, Artificial Sequence
  Description of Artificial Sequence: Synthetic oligonucleotide
  modified_base (20)..(21): 2'-methoxy-nucleotide
gaaagaucuacucccccauuu

SEQ ID NO: 3584 - RNA, 21 nt, Artificial Sequence
  Description of Artificial Sequence: Synthetic oligonucleotide
  modified_base (20)..(21): 2'-methoxy-nucleotide
agaaagaucuacucccccauu

SEQ ID NO: 3585 - RNA, 21 nt, Artificial Sequence
  Description of Artificial Sequence: Synthetic oligonucleotide
  modified_base (20)..(21): 2'-methoxy-nucleotide
uagaaagaucuacucccccuu

SEQ ID NO: 3586 - RNA, 21 nt, Artificial Sequence
  Description of Artificial Sequence: Synthetic oligonucleotide
  modified_base (20)..(21): 2'-methoxy-nucleotide
cuagaaagaucuacuccccuu

SEQ ID NO: 3587 - RNA, 21 nt, Artificial Sequence
  Description of Artificial Sequence: Synthetic oligonucleotide
  modified_base (20)..(21): 2'-methoxy-nucleotide
ccuagaaagaucuacucccuu

SEQ ID NO: 3588 - RNA, 21 nt, Artificial Sequence
  Description of Artificial Sequence: Synthetic oligonucleotide
  modified_base (20)..(21): 2'-methoxy-nucleotide
uccuagaaagaucuacuccuu

SEQ ID NO: 3589 - RNA, 21 nt, Artificial Sequence
  Description of Artificial Sequence: Synthetic oligonucleotide
  modified_base (20)..(21): 2'-methoxy-nucleotide
cuccuagaaagaucuacucuu

SEQ ID NO: 3590 - RNA, 21 nt, Artificial Sequence
  Description of Artificial Sequence: Synthetic oligonucleotide
  modified_base (20)..(21): 2'-methoxy-nucleotide
ccuccuagaaagaucuacuuu

SEQ ID NO: 3591 - RNA, 21 nt, Artificial Sequence
  Description of Artificial Sequence: Synthetic oligonucleotide
  modified_base (20)..(21): 2'-methoxy-nucleotide
cccuccuagaaagaucuacuu

SEQ ID NO: 3592 - RNA, 21 nt, Artificial Sequence
  Description of Artificial Sequence: Synthetic oligonucleotide
  modified_base (20)..(21): 2'-methoxy-nucleotide
ucccuccuagaaagaucuauu

SEQ ID NO: 3593 - RNA, 21 nt, Artificial Sequence
  Description of Artificial Sequence: Synthetic oligonucleotide
  modified_base (20)..(21): 2'-methoxy-nucleotide
cucccuccuagaaagaucuuu

SEQ ID NO: 3594 - RNA, 21 nt, Artificial Sequence
  Description of Artificial Sequence: Synthetic oligonucleotide
  modified_base (20)..(21): 2'-methoxy-nucleotide
ucucccuccuagaaagaucuu

SEQ ID NO: 3595 - RNA, 21 nt, Artificial Sequence
  Description of Artificial Sequence: Synthetic oligonucleotide
  modified_base (20)..(21): 2'-methoxy-nucleotide
gucucccuccuagaaagauuu

SEQ ID NO: 3596 - RNA, 21 nt, Artificial Sequence
  Description of Artificial Sequence: Synthetic oligonucleotide
  modified_base (20)..(21): 2'-methoxy-nucleotide
ugucucccuccuagaaagauu

SEQ ID NO: 3597 - RNA, 21 nt, Artificial Sequence
  Description of Artificial Sequence: Synthetic oligonucleotide
  modified_base (20)..(21): 2'-methoxy-nucleotide
gugucucccuccuagaaaguu

SEQ ID NO: 3598 - RNA, 21 nt, Artificial Sequence
  Description of Artificial Sequence: Synthetic oligonucleotide
  modified_base (20)..(21): 2'-methoxy-nucleotide
agugucucccuccuagaaauu

SEQ ID NO: 3599 - RNA, 21 nt, Artificial Sequence
  Description of Artificial Sequence: Synthetic oligonucleotide
  modified_base (20)..(21): 2'-methoxy-nucleotide
cagugucucccuccuagaauu

SEQ ID NO: 3600 - RNA, 21 nt, Artificial Sequence
  Description of Artificial Sequence: Synthetic oligonucleotide
  modified_base (20)..(21): 2'-methoxy-nucleotide
ccagugucucccuccuagauu

SEQ ID NO: 3601 - RNA, 21 nt, Artificial Sequence
  Description of Artificial Sequence: Synthetic oligonucleotide
  modified_base (20)..(21): 2'-methoxy-nucleotide
gccagugucucccuccuaguu

SEQ ID NO: 3602 - RNA, 21 nt, Artificial Sequence
  Description of Artificial Sequence: Synthetic oligonucleotide
  modified_base (20)..(21): 2'-methoxy-nucleotide
ggccagugucucccuccuauu

SEQ ID NO: 3603 - RNA, 21 nt, Artificial Sequence
  Description of Artificial Sequence: Synthetic oligonucleotide
  modified_base (20)..(21): 2'-methoxy-nucleotide
gggccagugucucccuccuuu

SEQ ID NO: 3604 - RNA, 21 nt, Artificial Sequence
  Description of Artificial Sequence: Synthetic oligonucleotide
  modified_base (20)..(21): 2'-methoxy-nucleotide
ggggccagugucucccuccuu

SEQ ID NO: 3605 - RNA, 21 nt, Artificial Sequence
  Description of Artificial Sequence: Synthetic oligonucleotide
  modified_base (20)..(21): 2'-methoxy-nucleotide
aggggccagugucucccucuu

SEQ ID NO: 3606 - RNA, 21 nt, Artificial Sequence
  Description of Artificial Sequence: Synthetic oligonucleotide
  modified_base (20)..(21): 2'-methoxy-nucleotide
gaggggccagugucucccuuu

SEQ ID NO: 3607 - RNA, 21 nt, Artificial Sequence
  Description of Artificial Sequence: Synthetic oligonucleotide
  modified_base (20)..(21): 2'-methoxy-nucleotide
ugaggggccagugucucccuu

SEQ ID NO: 3608 - RNA, 21 nt, Artificial Sequence
  Description of Artificial Sequence: Synthetic oligonucleotide
  modified_base (20)..(21): 2'-methoxy-nucleotide
uugaggggccagugucuccuu

SEQ ID NO: 3609 - RNA, 21 nt, Artificial Sequence
  Description of Artificial Sequence: Synthetic oligonucleotide
  modified_base (20)..(21): 2'-methoxy-nucleotide
uuugaggggccagugucucuu

SEQ ID NO: 3610 - RNA, 21 nt, Artificial Sequence
  Description of Artificial Sequence: Synthetic oligonucleotide
  modified_base (20)..(21): 2'-methoxy-nucleotide
auuugaggggccagugucuuu

SEQ ID NO: 3611 - RNA, 21 nt, Artificial Sequence
  Description of Artificial Sequence: Synthetic oligonucleotide
  modified_base (20)..(21): 2'-methoxy-nucleotide
gauuugaggggccagugucuu

SEQ ID NO: 3612 - RNA, 21 nt, Artificial Sequence
  Description of Artificial Sequence: Synthetic oligonucleotide
  modified_base (20)..(21): 2'-methoxy-nucleotide
cgauuugaggggccaguguuu

SEQ ID NO: 3613 - RNA, 21 nt, Artificial Sequence
  Description of Artificial Sequence: Synthetic oligonucleotide
  modified_base (20)..(21): 2'-methoxy-nucleotide
acgauuugaggggccaguguu

SEQ ID NO: 3614 - RNA, 21 nt, Artificial Sequence
  Description of Artificial Sequence: Synthetic oligonucleotide
  modified_base (20)..(21): 2'-methoxy-nucleotide
gacgauuugaggggccaguuu

SEQ ID NO: 3615 - RNA, 21 nt, Artificial Sequence
  Description of Artificial Sequence: Synthetic oligonucleotide
  modified_base (20)..(21): 2'-methoxy-nucleotide
ggacgauuugaggggccaguu

SEQ ID NO: 3616 - RNA, 21 nt, Artificial Sequence
  Description of Artificial Sequence: Synthetic oligonucleotide
  modified_base (20)..(21): 2'-methoxy-nucleotide
uggacgauuugaggggccauu

SEQ ID NO: 3617 - RNA, 21 nt, Artificial Sequence
  Description of Artificial Sequence: Synthetic oligonucleotide
  modified_base (20)..(21): 2'-methoxy-nucleotide
cuggacgauuugaggggccuu

SEQ ID NO: 3618 - RNA, 21 nt, Artificial Sequence
  Description of Artificial Sequence: Synthetic oligonucleotide
  modified_base (20)..(21): 2'-methoxy-nucleotide
gcuggacgauuugaggggcuu

SEQ ID NO: 3619 - RNA, 21 nt, Artificial Sequence
  Description of Artificial Sequence: Synthetic oligonucleotide
  modified_base (20)..(21): 2'-methoxy-nucleotide
cgcuggacgauuugagggguu

SEQ ID NO: 3620 - RNA, 21 nt, Artificial Sequence
  Description of Artificial Sequence: Synthetic oligonucleotide
  modified_base (20)..(21): 2'-methoxy-nucleotide
ucgcuggacgauuugaggguu

SEQ ID NO: 3621 - RNA, 21 nt, Artificial Sequence
  Description of Artificial Sequence: Synthetic oligonucleotide
  modified_base (20)..(21): 2'-methoxy-nucleotide
gucgcuggacgauuugagguu

SEQ ID NO: 3622 - RNA, 21 nt, Artificial Sequence
  Description of Artificial Sequence: Synthetic oligonucleotide
  modified_base (20)..(21): 2'-methoxy-nucleotide
ggucgcuggacgauuugaguu

SEQ ID NO: 3623 - RNA, 21 nt, Artificial Sequence
  Description of Artificial Sequence: Synthetic oligonucleotide
  modified_base (20)..(21): 2'-methoxy-nucleotide
aggucgcuggacgauuugauu

SEQ ID NO: 3624 - RNA, 21 nt, Artificial Sequence
  Description of Artificial Sequence: Synthetic oligonucleotide
  modified_base (20)..(21): 2'-methoxy-nucleotide
aaggucgcuggacgauuuguu

SEQ ID NO: 3625 - RNA, 21 nt, Artificial Sequence
  Description of Artificial Sequence: Synthetic oligonucleotide
  modified_base (20)..(21): 2'-methoxy-nucleotide
gaaggucgcuggacgauuuuu

SEQ ID NO: 3626 - RNA, 21 nt, Artificial Sequence
  Description of Artificial Sequence: Synthetic oligonucleotide
  modified_base (20)..(21): 2'-methoxy-nucleotide
ggaaggucgcuggacgauuuu

SEQ ID NO: 3627 - RNA, 21 nt, Artificial Sequence
  Description of Artificial Sequence: Synthetic oligonucleotide
  modified_base (20)..(21): 2'-methoxy-nucleotide
aggaaggucgcuggacgauuu

SEQ ID NO: 3628 - RNA, 21 nt, Artificial Sequence
  Description of Artificial Sequence: Synthetic oligonucleotide
  modified_base (20)..(21): 2'-methoxy-nucleotide
gaggaaggucgcuggacgauu

SEQ ID NO: 3629 - RNA, 21 nt, Artificial Sequence
  Description of Artificial Sequence: Synthetic oligonucleotide
  modified_base (20)..(21): 2'-methoxy-nucleotide
ugaggaaggucgcuggacguu

SEQ ID NO: 3630 - RNA, 21 nt, Artificial Sequence
  Description of Artificial Sequence: Synthetic oligonucleotide
  modified_base (20)..(21): 2'-methoxy-nucleotide
augaggaaggucgcuggacuu

SEQ ID NO: 3631 - RNA, 21 nt, Artificial Sequence
  Description of Artificial Sequence: Synthetic oligonucleotide
  modified_base (20)..(21): 2'-methoxy-nucleotide
gaugaggaaggucgcuggauu

SEQ ID NO: 3632 - RNA, 21 nt, Artificial Sequence
  Description of Artificial Sequence: Synthetic oligonucleotide
  modified_base (20)..(21): 2'-methoxy-nucleotide
ggaugaggaaggucgcugguu

SEQ ID NO: 3633 - RNA, 21 nt, Artificial Sequence
  Description of Artificial Sequence: Synthetic oligonucleotide
  modified_base (20)..(21): 2'-methoxy-nucleotide
uggaugaggaaggucgcuguu

SEQ ID NO: 3634 - RNA, 21 nt, Artificial Sequence
  Description of Artificial Sequence: Synthetic oligonucleotide
  modified_base (20)..(21): 2'-methoxy-nucleotide
guggaugaggaaggucgcuuu

SEQ ID NO: 3635 - RNA, 21 nt, Artificial Sequence
  Description of Artificial Sequence: Synthetic oligonucleotide
  modified_base (20)..(21): 2'-methoxy-nucleotide
gguggaugaggaaggucgcuu

SEQ ID NO: 3636 - RNA, 21 nt, Artificial Sequence
  Description of Artificial Sequence: Synthetic oligonucleotide
  modified_base (20)..(21): 2'-methoxy-nucleotide
ggguggaugaggaaggucguu

SEQ ID NO: 3637 - RNA, 21 nt, Artificial Sequence
  Description of Artificial Sequence: Synthetic oligonucleotide
  modified_base (20)..(21): 2'-methoxy-nucleotide
gggguggaugaggaaggucuu

SEQ ID NO: 3638 - RNA, 21 nt, Artificial Sequence
  Description of Artificial Sequence: Synthetic oligonucleotide
  modified_base (20)..(21): 2'-methoxy-nucleotide
ugggguggaugaggaagguuu

SEQ ID NO: 3639 - RNA, 21 nt, Artificial Sequence
  Description of Artificial Sequence: Synthetic oligonucleotide
  modified_base (20)..(21): 2'-methoxy-nucleotide
augggguggaugaggaagguu

SEQ ID NO: 3640 - RNA, 21 nt, Artificial Sequence
  Description of Artificial Sequence: Synthetic oligonucleotide
  modified_base (20)..(21): 2'-methoxy-nucleotide
gaugggguggaugaggaaguu

SEQ ID NO: 3641 - RNA, 21 nt, Artificial Sequence
  Description of Artificial Sequence: Synthetic oligonucleotide
  modified_base (20)..(21): 2'-methoxy-nucleotide
ggaugggguggaugaggaauu

SEQ ID NO: 3642 - RNA, 21 nt, Artificial Sequence
  Description of Artificial Sequence: Synthetic oligonucleotide
  modified_base (20)..(21): 2'-methoxy-nucleotide
gggaugggguggaugaggauu

SEQ ID NO: 3643 - RNA, 21 nt, Artificial Sequence
  Description of Artificial Sequence: Synthetic oligonucleotide
  modified_base (20)..(21): 2'-methoxy-nucleotide
agggaugggguggaugagguu

SEQ ID NO: 3644 - RNA, 21 nt, Artificial Sequence
  Description of Artificial Sequence: Synthetic oligonucleotide
  modified_base (20)..(21): 2'-methoxy-nucleotide
gagggaugggguggaugaguu

SEQ ID NO: 3645 - RNA, 21 nt, Artificial Sequence
  Description of Artificial Sequence: Synthetic oligonucleotide
  modified_base (20)..(21): 2'-methoxy-nucleotide
ggagggaugggguggaugauu

SEQ ID NO: 3646 - RNA, 21 nt, Artificial Sequence
  Description of Artificial Sequence: Synthetic oligonucleotide
  modified_base (20)..(21): 2'-methoxy-nucleotide
gggagggaugggguggauguu

SEQ ID NO: 3647 - RNA, 21 nt, Artificial Sequence
  Description of Artificial Sequence: Synthetic oligonucleotide
  modified_base (20)..(21): 2'-methoxy-nucleotide
ggggagggaugggguggauuu

SEQ ID NO: 3648 - RNA, 21 nt, Artificial Sequence
  Description of Artificial Sequence: Synthetic oligonucleotide
  modified_base (20)..(21): 2'-methoxy-nucleotide
uggggagggaugggguggauu

SEQ ID NO: 3649 - RNA, 21 nt, Artificial Sequence
  Description of Artificial Sequence: Synthetic oligonucleotide
  modified_base (20)..(21): 2'-methoxy-nucleotide
cuggggagggauggggugguu

SEQ ID NO: 3650 - RNA, 21 nt, Artificial Sequence
  Description of Artificial Sequence: Synthetic oligonucleotide
  modified_base (20)..(21): 2'-methoxy-nucleotide
acuggggagggaugggguguu

SEQ ID NO: 3651 - RNA, 21 nt, Artificial Sequence
  Description of Artificial Sequence: Synthetic oligonucleotide
  modified_base (20)..(21): 2'-methoxy-nucleotide
aacuggggagggaugggguuu

SEQ ID NO: 3652 - RNA, 21 nt, Artificial Sequence
  Description of Artificial Sequence: Synthetic oligonucleotide
  modified_base (20)..(21): 2'-methoxy-nucleotide
gaacuggggagggaugggguu

SEQ ID NO: 3653 - RNA, 21 nt, Artificial Sequence
  Description of Artificial Sequence: Synthetic oligonucleotide
  modified_base (20)..(21): 2'-methoxy-nucleotide
ugaacuggggagggauggguu

SEQ ID NO: 3654 - RNA, 21 nt, Artificial Sequence
  Description of Artificial Sequence: Synthetic oligonucleotide
  modified_base (20)..(21): 2'-methoxy-nucleotide
augaacuggggagggaugguu

SEQ ID NO: 3655 - RNA, 21 nt, Artificial Sequence
  Description of Artificial Sequence: Synthetic oligonucleotide
  modified_base (20)..(21): 2'-methoxy-nucleotide
aaugaacuggggagggauguu

SEQ ID NO: 3656 - RNA, 21 nt, Artificial Sequence
  Description of Artificial Sequence: Synthetic oligonucleotide
  modified_base (20)..(21): 2'-methoxy-nucleotide
caaugaacuggggagggauuu

SEQ ID NO: 3657 - RNA, 21 nt, Artificial Sequence
  Description of Artificial Sequence: Synthetic oligonucleotide
  modified_base (20)..(21): 2'-methoxy-nucleotide
gcaaugaacuggggagggauu

SEQ ID NO: 3658 - RNA, 21 nt, Artificial Sequence
  Description of Artificial Sequence: Synthetic oligonucleotide
  modified_base (20)..(21): 2'-methoxy-nucleotide
ugcaaugaacuggggaggguu

SEQ ID NO: 3659 - RNA, 21 nt, Artificial Sequence
  Description of Artificial Sequence: Synthetic oligonucleotide
  modified_base (20)..(21): 2'-methoxy-nucleotide
gugcaaugaacuggggagguu

SEQ ID NO: 3660 - RNA, 21 nt, Artificial Sequence
  Description of Artificial Sequence: Synthetic oligonucleotide
  modified_base (20)..(21): 2'-methoxy-nucleotide
agugcaaugaacuggggaguu

SEQ ID NO: 3661 - RNA, 21 nt, Artificial Sequence
  Description of Artificial Sequence: Synthetic oligonucleotide
  modified_base (20)..(21): 2'-methoxy-nucleotide
aagugcaaugaacuggggauu

SEQ ID NO: 3662 - RNA, 21 nt, Artificial Sequence
  Description of Artificial Sequence: Synthetic oligonucleotide
  modified_base (20)..(21): 2'-methoxy-nucleotide
aaagugcaaugaacugggguu

SEQ ID NO: 3663 - RNA, 21 nt, Artificial Sequence
  Description of Artificial Sequence: Synthetic oligonucleotide
  modified_base (20)..(21): 2'-methoxy-nucleotide
caaagugcaaugaacuggguu

SEQ ID NO: 3664 - RNA, 21 nt, Artificial Sequence
  Description of Artificial Sequence: Synthetic oligonucleotide
  modified_base (20)..(21): 2'-methoxy-nucleotide
ucaaagugcaaugaacugguu

SEQ ID NO: 3665 - RNA, 21 nt, Artificial Sequence
  Description of Artificial Sequence: Synthetic oligonucleotide
  modified_base (20)..(21): 2'-methoxy-nucleotide
aucaaagugcaaugaacuguu

SEQ ID NO: 3666 - RNA, 21 nt, Artificial Sequence
  Description of Artificial Sequence: Synthetic oligonucleotide
  modified_base (20)..(21): 2'-methoxy-nucleotide
aaucaaagugcaaugaacuuu

SEQ ID NO: 3667 - RNA, 21 nt, Artificial Sequence
  Description of Artificial Sequence: Synthetic oligonucleotide
  modified_base (20)..(21): 2'-methoxy-nucleotide
uaaucaaagugcaaugaacuu

SEQ ID NO: 3668 - RNA, 21 nt, Artificial Sequence
  Description of Artificial Sequence: Synthetic oligonucleotide
  modified_base (20)..(21): 2'-methoxy-nucleotide
cuaaucaaagugcaaugaauu

SEQ ID NO: 3669 - RNA, 21 nt, Artificial Sequence
  Description of Artificial Sequence: Synthetic oligonucleotide
  modified_base (20)..(21): 2'-methoxy-nucleotide
gcuaaucaaagugcaaugauu

SEQ ID NO: 3670 - RNA, 21 nt, Artificial Sequence
  Description of Artificial Sequence: Synthetic oligonucleotide
  modified_base (20)..(21): 2'-methoxy-nucleotide
ugcuaaucaaagugcaauguu

SEQ ID NO: 3671 - RNA, 21 nt, Artificial Sequence
  Description of Artificial Sequence: Synthetic oligonucleotide
  modified_base (20)..(21): 2'-methoxy-nucleotide
cugcuaaucaaagugcaauuu

SEQ ID NO: 3672 - RNA, 21 nt, Artificial Sequence
  Description of Artificial Sequence: Synthetic oligonucleotide
  modified_base (20)..(21): 2'-methoxy-nucleotide
gcugcuaaucaaagugcaauu

SEQ ID NO: 3673 - RNA, 21 nt, Artificial Sequence
  Description of Artificial Sequence: Synthetic oligonucleotide
  modified_base (20)..(21): 2'-methoxy-nucleotide
cgcugcuaaucaaagugcauu

SEQ ID NO: 3674 - RNA, 21 nt, Artificial Sequence
  Description of Artificial Sequence: Synthetic oligonucleotide
  modified_base (20)..(21): 2'-methoxy-nucleotide
ccgcugcuaaucaaagugcuu

SEQ ID NO: 3675 - RNA, 21 nt, Artificial Sequence
  Description of Artificial Sequence: Synthetic oligonucleotide
  modified_base (20)..(21): 2'-methoxy-nucleotide
uccgcugcuaaucaaaguguu

SEQ ID NO: 3676 - RNA, 21 nt, Artificial Sequence
  Description of Artificial Sequence: Synthetic oligonucleotide
  modified_base (20)..(21): 2'-methoxy-nucleotide
uuccgcugcuaaucaaaguuu

SEQ ID NO: 3677 - RNA, 21 nt, Artificial Sequence
  Description of Artificial Sequence: Synthetic oligonucleotide
  modified_base (20)..(21): 2'-methoxy-nucleotide
guuccgcugcuaaucaaaguu

SEQ ID NO: 3678 - RNA, 21 nt, Artificial Sequence
  Description of Artificial Sequence: Synthetic oligonucleotide
  modified_base (20)..(21): 2'-methoxy-nucleotide
uguuccgcugcuaaucaaauu

SEQ ID NO: 3679 - RNA, 21 nt, Artificial Sequence
  Description of Artificial Sequence: Synthetic oligonucleotide
  modified_base (20)..(21): 2'-methoxy-nucleotide
uuguuccgcugcuaaucaauu

SEQ ID NO: 3680 - RNA, 21 nt, Artificial Sequence
  Description of Artificial Sequence: Synthetic oligonucleotide
  modified_base (20)..(21): 2'-methoxy-nucleotide
cuuguuccgcugcuaaucauu

SEQ ID NO: 3681 - RNA, 21 nt, Artificial Sequence
  Description of Artificial Sequence: Synthetic oligonucleotide
  modified_base (20)..(21): 2'-methoxy-nucleotide
ccuuguuccgcugcuaaucuu

SEQ ID NO: 3682 - RNA, 21 nt, Artificial Sequence
  Description of Artificial Sequence: Synthetic oligonucleotide
  modified_base (20)..(21): 2'-methoxy-nucleotide
uccuuguuccgcugcuaauuu

SEQ ID NO: 3683 - RNA, 21 nt, Artificial Sequence
  Description of Artificial Sequence: Synthetic oligonucleotide
  modified_base (20)..(21): 2'-methoxy-nucleotide
cuccuuguuccgcugcuaauu

SEQ ID NO: 3684 - RNA, 21 nt, Artificial Sequence
  Description of Artificial Sequence: Synthetic oligonucleotide
  modified_base (20)..(21): 2'-methoxy-nucleotide
acuccuuguuccgcugcuauu

SEQ ID NO: 3685 - RNA, 21 nt, Artificial Sequence
  Description of Artificial Sequence: Synthetic oligonucleotide
  modified_base (20)..(21): 2'-methoxy-nucleotide
gacuccuuguuccgcugcuuu

SEQ ID NO: 3686 - RNA, 21 nt, Artificial Sequence
  Description of Artificial Sequence: Synthetic oligonucleotide
  modified_base (20)..(21): 2'-methoxy-nucleotide
ugacuccuuguuccgcugcuu

SEQ ID NO: 3687 - RNA, 21 nt, Artificial Sequence
  Description of Artificial Sequence: Synthetic oligonucleotide
  modified_base (20)..(21): 2'-methoxy-nucleotide
cugacuccuuguuccgcuguu

SEQ ID NO: 3688 - RNA, 21 nt, Artificial Sequence
  Description of Artificial Sequence: Synthetic oligonucleotide
  modified_base (20)..(21): 2'-methoxy-nucleotide
ucugacuccuuguuccgcuuu

SEQ ID NO: 3689 - RNA, 21 nt, Artificial Sequence
  Description of Artificial Sequence: Synthetic oligonucleotide
  modified_base (20)..(21): 2'-methoxy-nucleotide
gucugacuccuuguuccgcuu

SEQ ID NO: 3690 - RNA, 21 nt, Artificial Sequence
  Description of Artificial Sequence: Synthetic oligonucleotide
  modified_base (20)..(21): 2'-methoxy-nucleotide
ugucugacuccuuguuccguu

SEQ ID NO: 3691 - RNA, 21 nt, Artificial Sequence
  Description of Artificial Sequence: Synthetic oligonucleotide
  modified_base (20)..(21): 2'-methoxy-nucleotide
augucugacuccuuguuccuu

SEQ ID NO: 3692 - RNA, 21 nt, Artificial Sequence
  Description of Artificial Sequence: Synthetic oligonucleotide
  modified_base (20)..(21): 2'-methoxy-nucleotide
aaugucugacuccuuguucuu

SEQ ID NO: 3693 - RNA, 21 nt, Artificial Sequence
  Description of Artificial Sequence: Synthetic oligonucleotide
  modified_base (20)..(21): 2'-methoxy-nucleotide
aaaugucugacuccuuguuuu

SEQ ID NO: 3694 - RNA, 21 nt, Artificial Sequence
  Description of Artificial Sequence: Synthetic oligonucleotide
  modified_base (20)..(21): 2'-methoxy-nucleotide
aaaaugucugacuccuuguuu

SEQ ID NO: 3695 - RNA, 21 nt, Artificial Sequence
  Description of Artificial Sequence: Synthetic oligonucleotide
  modified_base (20)..(21): 2'-methoxy-nucleotide
uaaaaugucugacuccuuguu

SEQ ID NO: 3696 - RNA, 21 nt, Artificial Sequence
  Description of Artificial Sequence: Synthetic oligonucleotide
  modified_base (20)..(21): 2'-methoxy-nucleotide
uuaaaaugucugacuccuuuu

SEQ ID NO: 3697 - RNA, 21 nt, Artificial Sequence
  Description of Artificial Sequence: Synthetic oligonucleotide
  modified_base (20)..(21): 2'-methoxy-nucleotide
cuuaaaaugucugacuccuuu

SEQ ID NO: 3698 - RNA, 21 nt, Artificial Sequence
  Description of Artificial Sequence: Synthetic oligonucleotide
  modified_base (20)..(21): 2'-methoxy-nucleotide
ucuuaaaaugucugacuccuu

SEQ ID NO: 3699 - RNA, 21 nt, Artificial Sequence
  Description of Artificial Sequence: Synthetic oligonucleotide
  modified_base (20)..(21): 2'-methoxy-nucleotide
aucuuaaaaugucugacucuu

SEQ ID NO: 3700 - RNA, 21 nt, Artificial Sequence
  Description of Artificial Sequence: Synthetic oligonucleotide
  modified_base (20)..(21): 2'-methoxy-nucleotide
caucuuaaaaugucugacuuu

SEQ ID NO: 3701 - RNA, 21 nt, Artificial Sequence
  Description of Artificial Sequence: Synthetic oligonucleotide
  modified_base (20)..(21): 2'-methoxy-nucleotide
ccaucuuaaaaugucugacuu

SEQ ID NO: 3702 - RNA, 21 nt, Artificial Sequence
  Description of Artificial Sequence: Synthetic oligonucleotide
  modified_base (20)..(21): 2'-methoxy-nucleotide
accaucuuaaaaugucugauu

SEQ ID NO: 3703 - RNA, 21 nt, Artificial Sequence
  Description of Artificial Sequence: Synthetic oligonucleotide
  modified_base (20)..(21): 2'-methoxy-nucleotide
caccaucuuaaaaugucuguu

SEQ ID NO: 3704 - RNA, 21 nt, Artificial Sequence
  Description of Artificial Sequence: Synthetic oligonucleotide
  modified_base (20)..(21): 2'-methoxy-nucleotide
ccaccaucuuaaaaugucuuu

SEQ ID NO: 3705 - RNA, 21 nt, Artificial Sequence
  Description of Artificial Sequence: Synthetic oligonucleotide
  modified_base (20)..(21): 2'-methoxy-nucleotide
gccaccaucuuaaaaugucuu

SEQ ID NO: 3706 - RNA, 21 nt, Artificial Sequence
  Description of Artificial Sequence: Synthetic oligonucleotide
  modified_base (20)..(21): 2'-methoxy-nucleotide
ugccaccaucuuaaaauguuu

SEQ ID NO: 3707 - RNA, 21 nt, Artificial Sequence
  Description of Artificial Sequence: Synthetic oligonucleotide
  modified_base (20)..(21): 2'-methoxy-nucleotide
cugccaccaucuuaaaauguu

SEQ ID NO: 3708 - RNA, 21 nt, Artificial Sequence
  Description of Artificial Sequence: Synthetic oligonucleotide
  modified_base (20)..(21): 2'-methoxy-nucleotide
acugccaccaucuuaaaauuu

SEQ ID NO: 3709 - RNA, 21 nt, Artificial Sequence
  Description of Artificial Sequence: Synthetic oligonucleotide
  modified_base (20)..(21): 2'-methoxy-nucleotide
uacugccaccaucuuaaaauu

SEQ ID NO: 3710 - RNA, 21 nt, Artificial Sequence
  Description of Artificial Sequence: Synthetic oligonucleotide
  modified_base (20)..(21): 2'-methoxy-nucleotide
cuacugccaccaucuuaaauu

SEQ ID NO: 3711 - RNA, 21 nt, Artificial Sequence
  Description of Artificial Sequence: Synthetic oligonucleotide
  modified_base (20)..(21): 2'-methoxy-nucleotide
ucuacugccaccaucuuaauu

SEQ ID NO: 3712 - RNA, 21 nt, Artificial Sequence
  Description of Artificial Sequence: Synthetic oligonucleotide
  modified_base (20)..(21): 2'-methoxy-nucleotide
cucuacugccaccaucuuauu

SEQ ID NO: 3713 - RNA, 21 nt, Artificial Sequence
  Description of Artificial Sequence: Synthetic oligonucleotide
  modified_base (20)..(21): 2'-methoxy-nucleotide
ccucuacugccaccaucuuuu

SEQ ID NO: 3714 - RNA, 21 nt, Artificial Sequence
  Description of Artificial Sequence: Synthetic oligonucleotide
  modified_base (20)..(21): 2'-methoxy-nucleotide
gccucuacugccaccaucuuu

SEQ ID NO: 3715 - RNA, 21 nt, Artificial Sequence
  Description of Artificial Sequence: Synthetic oligonucleotide
  modified_base (20)..(21): 2'-methoxy-nucleotide
agccucuacugccaccaucuu

SEQ ID NO: 3716 - RNA, 21 nt, Artificial Sequence
  Description of Artificial Sequence: Synthetic oligonucleotide
  modified_base (20)..(21): 2'-methoxy-nucleotide
uagccucuacugccaccauuu

SEQ ID NO: 3717 - RNA, 21 nt, Artificial Sequence
  Description of Artificial Sequence: Synthetic oligonucleotide
  modified_base (20)..(21): 2'-methoxy-nucleotide
auagccucuacugccaccauu

SEQ ID NO: 3718 - RNA, 21 nt, Artificial Sequence
  Description of Artificial Sequence: Synthetic oligonucleotide
  modified_base (20)..(21): 2'-methoxy-nucleotide
cauagccucuacugccaccuu

SEQ ID NO: 3719 - RNA, 21 nt, Artificial Sequence
  Description of Artificial Sequence: Synthetic oligonucleotide
  modified_base (20)..(21): 2'-methoxy-nucleotide
ccauagccucuacugccacuu

SEQ ID NO: 3720 - RNA, 21 nt, Artificial Sequence
  Description of Artificial Sequence: Synthetic oligonucleotide
  modified_base (20)..(21): 2'-methoxy-nucleotide
uccauagccucuacugccauu

SEQ ID NO: 3721 - RNA, 21 nt, Artificial Sequence
  Description of Artificial Sequence: Synthetic oligonucleotide
  modified_base (20)..(21): 2'-methoxy-nucleotide
guccauagccucuacugccuu

SEQ ID NO: 3722 - RNA, 21 nt, Artificial Sequence
  Description of Artificial Sequence: Synthetic oligonucleotide
  modified_base (20)..(21): 2'-methoxy-nucleotide
uguccauagccucuacugcuu

SEQ ID NO: 3723 - RNA, 21 nt, Artificial Sequence
  Description of Artificial Sequence: Synthetic oligonucleotide
  modified_base (20)..(21): 2'-methoxy-nucleotide
cuguccauagccucuacuguu

SEQ ID NO: 3724 - RNA, 21 nt, Artificial Sequence
  Description of Artificial Sequence: Synthetic oligonucleotide
  modified_base (20)..(21): 2'-methoxy-nucleotide
ccuguccauagccucuacuuu

SEQ ID NO: 3725 - RNA, 21 nt, Artificial Sequence
  Description of Artificial Sequence: Synthetic oligonucleotide
  modified_base (20)..(21): 2'-methoxy-nucleotide
cccuguccauagccucuacuu

SEQ ID NO: 3726 - RNA, 21 nt, Artificial Sequence
  Description of Artificial Sequence: Synthetic oligonucleotide
  modified_base (20)..(21): 2'-methoxy-nucleotide
gcccuguccauagccucuauu

SEQ ID NO: 3727 - RNA, 21 nt, Artificial Sequence
  Description of Artificial Sequence: Synthetic oligonucleotide
  modified_base (20)..(21): 2'-methoxy-nucleotide
ugcccuguccauagccucuuu

SEQ ID NO: 3728 - RNA, 21 nt, Artificial Sequence
  Description of Artificial Sequence: Synthetic oligonucleotide
  modified_base (20)..(21): 2'-methoxy-nucleotide
augcccuguccauagccucuu

SEQ ID NO: 3729 - RNA, 21 nt, Artificial Sequence
  Description of Artificial Sequence: Synthetic oligonucleotide
  modified_base (20)..(21): 2'-methoxy-nucleotide
caugcccuguccauagccuuu

SEQ ID NO: 3730 - RNA, 21 nt, Artificial Sequence
  Description of Artificial Sequence: Synthetic oligonucleotide
  modified_base (20)..(21): 2'-methoxy-nucleotide
gcaugcccuguccauagccuu

SEQ ID NO: 3731 - RNA, 21 nt, Artificial Sequence
  Description of Artificial Sequence: Synthetic oligonucleotide
  modified_base (20)..(21): 2'-methoxy-nucleotide
ggcaugcccuguccauagcuu

SEQ ID NO: 3732 - RNA, 21 nt, Artificial Sequence
  Description of Artificial Sequence: Synthetic oligonucleotide
  modified_base (20)..(21): 2'-methoxy-nucleotide
uggcaugcccuguccauaguu

SEQ ID NO: 3733 - RNA, 21 nt, Artificial Sequence
  Description of Artificial Sequence: Synthetic oligonucleotide
  modified_base (20)..(21): 2'-methoxy-nucleotide
guggcaugcccuguccauauu

SEQ ID NO: 3734 - RNA, 21 nt, Artificial Sequence
  Description of Artificial Sequence: Synthetic oligonucleotide
  modified_base (20)..(21): 2'-methoxy-nucleotide
cguggcaugcccuguccauuu

SEQ ID NO: 3735 - RNA, 21 nt, Artificial Sequence
  Description of Artificial Sequence: Synthetic oligonucleotide
  modified_base (20)..(21): 2'-methoxy-nucleotide
acguggcaugcccuguccauu

SEQ ID NO: 3736 - RNA, 21 nt, Artificial Sequence
  Description of Artificial Sequence: Synthetic oligonucleotide
  modified_base (20)..(21): 2'-methoxy-nucleotide
cacguggcaugcccuguccuu

SEQ ID NO: 3737 - RNA, 21 nt, Artificial Sequence
  Description of Artificial Sequence: Synthetic oligonucleotide
  modified_base (20)..(21): 2'-methoxy-nucleotide
ccacguggcaugcccugucuu

SEQ ID NO: 3738 - RNA, 21 nt, Artificial Sequence
  Description of Artificial Sequence: Synthetic oligonucleotide
  modified_base (20)..(21): 2'-methoxy-nucleotide
cccacguggcaugcccuguuu

SEQ ID NO: 3739 - RNA, 21 nt, Artificial Sequence
  Description of Artificial Sequence: Synthetic oligonucleotide
  modified_base (20)..(21): 2'-methoxy-nucleotide
gcccacguggcaugcccuguu

SEQ ID NO: 3740 - RNA, 21 nt, Artificial Sequence
  Description of Artificial Sequence: Synthetic oligonucleotide
  modified_base (20)..(21): 2'-methoxy-nucleotide
agcccacguggcaugcccuuu

SEQ ID NO: 3741 - RNA, 21 nt, Artificial Sequence
  Description of Artificial Sequence: Synthetic oligonucleotide
  modified_base (20)..(21): 2'-methoxy-nucleotide
gagcccacguggcaugcccuu

SEQ ID NO: 3742 - RNA, 21 nt, Artificial Sequence
  Description of Artificial Sequence: Synthetic oligonucleotide
  modified_base (20)..(21): 2'-methoxy-nucleotide
ugagcccacguggcaugccuu

SEQ ID NO: 3743 - RNA, 21 nt, Artificial Sequence
  Description of Artificial Sequence: Synthetic oligonucleotide
  modified_base (20)..(21): 2'-methoxy-nucleotide
augagcccacguggcaugcuu

SEQ ID NO: 3744 - RNA, 21 nt, Artificial Sequence
  Description of Artificial Sequence: Synthetic oligonucleotide
  modified_base (20)..(21): 2'-methoxy-nucleotide
uaugagcccacguggcauguu

SEQ ID NO: 3745 - RNA, 21 nt, Artificial Sequence
  Description of Artificial Sequence: Synthetic oligonucleotide
  modified_base (20)..(21): 2'-methoxy-nucleotide
auaugagcccacguggcauuu

SEQ ID NO: 3746 - RNA, 21 nt, Artificial Sequence
  Description of Artificial Sequence: Synthetic oligonucleotide
  modified_base (20)..(21): 2'-methoxy-nucleotide
cauaugagcccacguggcauu

SEQ ID NO: 3747 - RNA, 21 nt, Artificial Sequence
  Description of Artificial Sequence: Synthetic oligonucleotide
  modified_base (20)..(21): 2'-methoxy-nucleotide
ccauaugagcccacguggcuu

SEQ ID NO: 3748 - RNA, 21 nt, Artificial Sequence
  Description of Artificial Sequence: Synthetic oligonucleotide
  modified_base (20)..(21): 2'-methoxy-nucleotide
cccauaugagcccacgugguu

SEQ ID NO: 3749 - RNA, 21 nt, Artificial Sequence
  Description of Artificial Sequence: Synthetic oligonucleotide
  modified_base (20)..(21): 2'-methoxy-nucleotide
ccccauaugagcccacguguu

SEQ ID NO: 3750 - RNA, 21 nt, Artificial Sequence
  Description of Artificial Sequence: Synthetic oligonucleotide
  modified_base (20)..(21): 2'-methoxy-nucleotide
gccccauaugagcccacguuu

SEQ ID NO: 3751 - RNA, 21 nt, Artificial Sequence
  Description of Artificial Sequence: Synthetic oligonucleotide
  modified_base (20)..(21): 2'-methoxy-nucleotide
agccccauaugagcccacguu

SEQ ID NO: 3752 - RNA, 21 nt, Artificial Sequence
  Description of Artificial Sequence: Synthetic oligonucleotide
  modified_base (20)..(21): 2'-methoxy-nucleotide
cagccccauaugagcccacuu

SEQ ID NO: 3753 - RNA, 21 nt, Artificial Sequence
  Description of Artificial Sequence: Synthetic oligonucleotide
  modified_base (20)..(21): 2'-methoxy-nucleotide
ccagccccauaugagcccauu

SEQ ID NO: 3754 - RNA, 21 nt, Artificial Sequence
  Description of Artificial Sequence: Synthetic oligonucleotide
  modified_base (20)..(21): 2'-methoxy-nucleotide
cccagccccauaugagcccuu

SEQ ID NO: 3755 - RNA, 21 nt, Artificial Sequence
  Description of Artificial Sequence: Synthetic oligonucleotide
  modified_base (20)..(21): 2'-methoxy-nucleotide
ucccagccccauaugagccuu

SEQ ID NO: 3756 - RNA, 21 nt, Artificial Sequence
  Description of Artificial Sequence: Synthetic oligonucleotide
  modified_base (20)..(21): 2'-methoxy-nucleotide
cucccagccccauaugagcuu

SEQ ID NO: 3757 - RNA, 21 nt, Artificial Sequence
  Description of Artificial Sequence: Synthetic oligonucleotide
  modified_base (20)..(21): 2'-methoxy-nucleotide
acucccagccccauaugaguu

SEQ ID NO: 3758 - RNA, 21 nt, Artificial Sequence
  Description of Artificial Sequence: Synthetic oligonucleotide
  modified_base (20)..(21): 2'-methoxy-nucleotide
uacucccagccccauaugauu

SEQ ID NO: 3759 - RNA, 21 nt, Artificial Sequence
  Description of Artificial Sequence: Synthetic oligonucleotide
  modified_base (20)..(21): 2'-methoxy-nucleotide
cuacucccagccccauauguu

SEQ ID NO: 3760 - RNA, 21 nt, Artificial Sequence
  Description of Artificial Sequence: Synthetic oligonucleotide
  modified_base (20)..(21): 2'-methoxy-nucleotide
acuacucccagccccauauuu

SEQ ID NO: 3761 - RNA, 21 nt, Artificial Sequence
  Description of Artificial Sequence: Synthetic oligonucleotide
  modified_base (20)..(21): 2'-methoxy-nucleotide
aacuacucccagccccauauu

SEQ ID NO: 3762 - RNA, 21 nt, Artificial Sequence
  Description of Artificial Sequence: Synthetic oligonucleotide
  modified_base (20)..(21): 2'-methoxy-nucleotide
caacuacucccagccccauuu

SEQ ID NO: 3763 - RNA, 21 nt, Artificial Sequence
  Description of Artificial Sequence: Synthetic oligonucleotide
  modified_base (20)..(21): 2'-methoxy-nucleotide
acaacuacucccagccccauu

SEQ ID NO: 3764 - RNA, 21 nt, Artificial Sequence
  Description of Artificial Sequence: Synthetic oligonucleotide
  modified_base (20)..(21): 2'-methoxy-nucleotide
gacaacuacucccagccccuu

SEQ ID NO: 3765 - RNA, 21 nt, Artificial Sequence
  Description of Artificial Sequence: Synthetic oligonucleotide
  modified_base (20)..(21): 2'-methoxy-nucleotide
agacaacuacucccagcccuu

SEQ ID NO: 3766 - RNA, 21 nt, Artificial Sequence
  Description of Artificial Sequence: Synthetic oligonucleotide
  modified_base (20)..(21): 2'-methoxy-nucleotide
aagacaacuacucccagccuu

SEQ ID NO: 3767 - RNA, 21 nt, Artificial Sequence
  Description of Artificial Sequence: Synthetic oligonucleotide
  modified_base (20)..(21): 2'-methoxy-nucleotide
aaagacaacuacucccagcuu

SEQ ID NO: 3768 - RNA, 21 nt, Artificial Sequence
  Description of Artificial Sequence: Synthetic oligonucleotide
  modified_base (20)..(21): 2'-methoxy-nucleotide
gaaagacaacuacucccaguu

SEQ ID NO: 3769 - RNA, 21 nt, Artificial Sequence
  Description of Artificial Sequence: Synthetic oligonucleotide
  modified_base (20)..(21): 2'-methoxy-nucleotide
ggaaagacaacuacucccauu

SEQ ID NO: 3770 - RNA, 21 nt, Artificial Sequence
  Description of Artificial Sequence: Synthetic oligonucleotide
  modified_base (20)..(21): 2'-methoxy-nucleotide
aggaaagacaacuacucccuu

SEQ ID NO: 3771 - RNA, 21 nt, Artificial Sequence
  Description of Artificial Sequence: Synthetic oligonucleotide
  modified_base (20)..(21): 2'-methoxy-nucleotide
caggaaagacaacuacuccuu

SEQ ID NO: 3772 - RNA, 21 nt, Artificial Sequence
  Description of Artificial Sequence: Synthetic oligonucleotide
  modified_base (20)..(21): 2'-methoxy-nucleotide
ccaggaaagacaacuacucuu

SEQ ID NO: 3773 - RNA, 21 nt, Artificial Sequence
  Description of Artificial Sequence: Synthetic oligonucleotide
  modified_base (20)..(21): 2'-methoxy-nucleotide
gccaggaaagacaacuacuuu

SEQ ID NO: 3774 - RNA, 21 nt, Artificial Sequence
  Description of Artificial Sequence: Synthetic oligonucleotide
  modified_base (20)..(21): 2'-methoxy-nucleotide
ugccaggaaagacaacuacuu

SEQ ID NO: 3775 - RNA, 21 nt, Artificial Sequence
  Description of Artificial Sequence: Synthetic oligonucleotide
  modified_base (20)..(21): 2'-methoxy-nucleotide
gugccaggaaagacaacuauu

SEQ ID NO: 3776 - RNA, 21 nt, Artificial Sequence
  Description of Artificial Sequence: Synthetic oligonucleotide
  modified_base (20)..(21): 2'-methoxy-nucleotide
agugccaggaaagacaacuuu

SEQ ID NO: 3777 - RNA, 21 nt, Artificial Sequence
  Description of Artificial Sequence: Synthetic oligonucleotide
  modified_base (20)..(21): 2'-methoxy-nucleotide
uagugccaggaaagacaacuu

SEQ ID NO: 3778 - RNA, 21 nt, Artificial Sequence
  Description of Artificial Sequence: Synthetic oligonucleotide
  modified_base (20)..(21): 2'-methoxy-nucleotide
uuagugccaggaaagacaauu

SEQ ID NO: 3779 - RNA, 21 nt, Artificial Sequence
  Description of Artificial Sequence: Synthetic oligonucleotide
  modified_base (20)..(21): 2'-methoxy-nucleotide
guuagugccaggaaagacauu

SEQ ID NO: 3780 - RNA, 21 nt, Artificial Sequence
  Description of Artificial Sequence: Synthetic oligonucleotide
  modified_base (20)..(21): 2'-methoxy-nucleotide
cguuagugccaggaaagacuu

SEQ ID NO: 3781 - RNA, 21 nt, Artificial Sequence
  Description of Artificial Sequence: Synthetic oligonucleotide
  modified_base (20)..(21): 2'-methoxy-nucleotide
acguuagugccaggaaagauu

SEQ ID NO: 3782 - RNA, 21 nt, Artificial Sequence
  Description of Artificial Sequence: Synthetic oligonucleotide
  modified_base (20)..(21): 2'-methoxy-nucleotide
aacguuagugccaggaaaguu

SEQ ID NO: 3783 - RNA, 21 nt, Artificial Sequence
  Description of Artificial Sequence: Synthetic oligonucleotide
  modified_base (20)..(21): 2'-methoxy-nucleotide
caacguuagugccaggaaauu

SEQ ID NO: 3784 - RNA, 21 nt, Artificial Sequence
  Description of Artificial Sequence: Synthetic oligonucleotide
  modified_base (20)..(21): 2'-methoxy-nucleotide
ucaacguuagugccaggaauu

SEQ ID NO: 3785 - RNA, 21 nt, Artificial Sequence
  Description of Artificial Sequence: Synthetic oligonucleotide
  modified_base (20)..(21): 2'-methoxy-nucleotide
cucaacguuagugccaggauu

SEQ ID NO: 3786 - RNA, 21 nt, Artificial Sequence
  Description of Artificial Sequence: Synthetic oligonucleotide
  modified_base (20)..(21): 2'-methoxy-nucleotide
gcucaacguuagugccagguu

SEQ ID NO: 3787 - RNA, 21 nt, Artificial Sequence
  Description of Artificial Sequence: Synthetic oligonucleotide
  modified_base (20)..(21): 2'-methoxy-nucleotide
ggcucaacguuagugccaguu

SEQ ID NO: 3788 - RNA, 21 nt, Artificial Sequence
  Description of Artificial Sequence: Synthetic oligonucleotide
  modified_base (20)..(21): 2'-methoxy-nucleotide
gggcucaacguuagugccauu

SEQ ID NO: 3789 - RNA, 21 nt, Artificial Sequence
  Description of Artificial Sequence: Synthetic oligonucleotide
  modified_base (20)..(21): 2'-methoxy-nucleotide
ggggcucaacguuagugccuu

SEQ ID NO: 3790 - RNA, 21 nt, Artificial Sequence
  Description of Artificial Sequence: Synthetic oligonucleotide
  modified_base (20)..(21): 2'-methoxy-nucleotide
aggggcucaacguuagugcuu

SEQ ID NO: 3791 - RNA, 21 nt, Artificial Sequence
  Description of Artificial Sequence: Synthetic oligonucleotide
  modified_base (20)..(21): 2'-methoxy-nucleotide
caggggcucaacguuaguguu

SEQ ID NO: 3792 - RNA, 21 nt, Artificial Sequence
  Description of Artificial Sequence: Synthetic oligonucleotide
  modified_base (20)..(21): 2'-methoxy-nucleotide
ccaggggcucaacguuaguuu

SEQ ID NO: 3793 - RNA, 21 nt, Artificial Sequence
  Description of Artificial Sequence: Synthetic oligonucleotide
  modified_base (20)..(21): 2'-methoxy-nucleotide
uccaggggcucaacguuaguu

SEQ ID NO: 3794 - RNA, 21 nt, Artificial Sequence
  Description of Artificial Sequence: Synthetic oligonucleotide
  modified_base (20)..(21): 2'-methoxy-nucleotide
cuccaggggcucaacguuauu

SEQ ID NO: 3795 - RNA, 21 nt, Artificial Sequence
  Description of Artificial Sequence: Synthetic oligonucleotide
  modified_base (20)..(21): 2'-methoxy-nucleotide
ccuccaggggcucaacguuuu

SEQ ID NO: 3796 - RNA, 21 nt, Artificial Sequence
  Description of Artificial Sequence: Synthetic oligonucleotide
  modified_base (20)..(21): 2'-methoxy-nucleotide
gccuccaggggcucaacguuu

SEQ ID NO: 3797 - RNA, 21 nt, Artificial Sequence
  Description of Artificial Sequence: Synthetic oligonucleotide
  modified_base (20)..(21): 2'-methoxy-nucleotide
ugccuccaggggcucaacguu

SEQ ID NO: 3798 - RNA, 21 nt, Artificial Sequence
  Description of Artificial Sequence: Synthetic oligonucleotide
  modified_base (20)..(21): 2'-methoxy-nucleotide
gugccuccaggggcucaacuu

SEQ ID NO: 3799 - RNA, 21 nt, Artificial Sequence
  Description of Artificial Sequence: Synthetic oligonucleotide
  modified_base (20)..(21): 2'-methoxy-nucleotide
agugccuccaggggcucaauu

SEQ ID NO: 3800 - RNA, 21 nt, Artificial Sequence
  Description of Artificial Sequence: Synthetic oligonucleotide
  modified_base (20)..(21): 2'-methoxy-nucleotide
cagugccuccaggggcucauu

SEQ ID NO: 3801 - RNA, 21 nt, Artificial Sequence
  Description of Artificial Sequence: Synthetic oligonucleotide
  modified_base (20)..(21): 2'-methoxy-nucleotide
ucagugccuccaggggcucuu

SEQ ID NO: 3802 - RNA, 21 nt, Artificial Sequence
  Description of Artificial Sequence: Synthetic oligonucleotide
  modified_base (20)..(21): 2'-methoxy-nucleotide
uucagugccuccaggggcuuu

SEQ ID NO: 3803 - RNA, 21 nt, Artificial Sequence
  Description of Artificial Sequence: Synthetic oligonucleotide
  modified_base (20)..(21): 2'-methoxy-nucleotide
cuucagugccuccaggggcuu

SEQ ID NO: 3804 - RNA, 21 nt, Artificial Sequence
  Description of Artificial Sequence: Synthetic oligonucleotide
  modified_base (20)..(21): 2'-methoxy-nucleotide
acuucagugccuccagggguu

SEQ ID NO: 3805 - RNA, 21 nt, Artificial Sequence
  Description of Artificial Sequence: Synthetic oligonucleotide
  modified_base (20)..(21): 2'-methoxy-nucleotide
cacuucagugccuccaggguu

SEQ ID NO: 3806 - RNA, 21 nt, Artificial Sequence
  Description of Artificial Sequence: Synthetic oligonucleotide
  modified_base (20)..(21): 2'-methoxy-nucleotide
gcacuucagugccuccagguu

SEQ ID NO: 3807 - RNA, 21 nt, Artificial Sequence
  Description of Artificial Sequence: Synthetic oligonucleotide
  modified_base (20)..(21): 2'-methoxy-nucleotide
agcacuucagugccuccaguu

SEQ ID NO: 3808 - RNA, 21 nt, Artificial Sequence
  Description of Artificial Sequence: Synthetic oligonucleotide
  modified_base (20)..(21): 2'-methoxy-nucleotide
aagcacuucagugccuccauu

SEQ ID NO: 3809 - RNA, 21 nt, Artificial Sequence
  Description of Artificial Sequence: Synthetic oligonucleotide
  modified_base (20)..(21): 2'-methoxy-nucleotide
uaagcacuucagugccuccuu

SEQ ID NO: 3810 - RNA, 21 nt, Artificial Sequence
  Description of Artificial Sequence: Synthetic oligonucleotide
  modified_base (20)..(21): 2'-methoxy-nucleotide
cuaagcacuucagugccucuu

SEQ ID NO: 3811 - RNA, 21 nt, Artificial Sequence
  Description of Artificial Sequence: Synthetic oligonucleotide
  modified_base (20)..(21): 2'-methoxy-nucleotide
acuaagcacuucagugccuuu

SEQ ID NO: 3812 - RNA, 21 nt, Artificial Sequence
  Description of Artificial Sequence: Synthetic oligonucleotide
  modified_base (20)..(21): 2'-methoxy-nucleotide
cacuaagcacuucagugccuu

SEQ ID NO: 3813 - RNA, 21 nt, Artificial Sequence
  Description of Artificial Sequence: Synthetic oligonucleotide
  modified_base (20)..(21): 2'-methoxy-nucleotide
acacuaagcacuucagugcuu

SEQ ID NO: 3814 - RNA, 21 nt, Artificial Sequence
  Description of Artificial Sequence: Synthetic oligonucleotide
  modified_base (20)..(21): 2'-methoxy-nucleotide
uacacuaagcacuucaguguu

SEQ ID NO: 3815 - RNA, 21 nt, Artificial Sequence
  Description of Artificial Sequence: Synthetic oligonucleotide
  modified_base (20)..(21): 2'-methoxy-nucleotide
guacacuaagcacuucaguuu

SEQ ID NO: 3816 - RNA, 21 nt, Artificial Sequence
  Description of Artificial Sequence: Synthetic oligonucleotide
  modified_base (20)..(21): 2'-methoxy-nucleotide
aguacacuaagcacuucaguu

SEQ ID NO: 3817 - RNA, 21 nt, Artificial Sequence
  Description of Artificial Sequence: Synthetic oligonucleotide
  modified_base (20)..(21): 2'-methoxy-nucleotide
aaguacacuaagcacuucauu

SEQ ID NO: 3818 - RNA, 21 nt, Artificial Sequence
  Description of Artificial Sequence: Synthetic oligonucleotide
  modified_base (20)..(21): 2'-methoxy-nucleotide
caaguacacuaagcacuucuu

SEQ ID NO: 3819 - RNA, 21 nt, Artificial Sequence
  Description of Artificial Sequence: Synthetic oligonucleotide
  modified_base (20)..(21): 2'-methoxy-nucleotide
ccaaguacacuaagcacuuuu

SEQ ID NO: 3820 - RNA, 21 nt, Artificial Sequence
  Description of Artificial Sequence: Synthetic oligonucleotide
  modified_base (20)..(21): 2'-methoxy-nucleotide
uccaaguacacuaagcacuuu

SEQ ID NO: 3821 - RNA, 21 nt, Artificial Sequence
  Description of Artificial Sequence: Synthetic oligonucleotide
  modified_base (20)..(21): 2'-methoxy-nucleotide
cuccaaguacacuaagcacuu

SEQ ID NO: 3822 - RNA, 21 nt, Artificial Sequence
  Description of Artificial Sequence: Synthetic oligonucleotide
  modified_base (20)..(21): 2'-methoxy-nucleotide
acuccaaguacacuaagcauu

SEQ ID NO: 3823 - RNA, 21 nt, Artificial Sequence
  Description of Artificial Sequence: Synthetic oligonucleotide
  modified_base (20)..(21): 2'-methoxy-nucleotide
uacuccaaguacacuaagcuu

SEQ ID NO: 3824 - RNA, 21 nt, Artificial Sequence
  Description of Artificial Sequence: Synthetic oligonucleotide
  modified_base (20)..(21): 2'-methoxy-nucleotide
auacuccaaguacacuaaguu

SEQ ID NO: 3825 - RNA, 21 nt, Artificial Sequence
  Description of Artificial Sequence: Synthetic oligonucleotide
  modified_base (20)..(21): 2'-methoxy-nucleotide
aauacuccaaguacacuaauu

SEQ ID NO: 3826 - RNA, 21 nt, Artificial Sequence
  Description of Artificial Sequence: Synthetic oligonucleotide
  modified_base (20)..(21): 2'-methoxy-nucleotide
caauacuccaaguacacuauu

SEQ ID NO: 3827 - RNA, 21 nt, Artificial Sequence
  Description of Artificial Sequence: Synthetic oligonucleotide
  modified_base (20)..(21): 2'-methoxy-nucleotide
ccaauacuccaaguacacuuu

SEQ ID NO: 3828 - RNA, 21 nt, Artificial Sequence
  Description of Artificial Sequence: Synthetic oligonucleotide
  modified_base (20)..(21): 2'-methoxy-nucleotide
cccaauacuccaaguacacuu

SEQ ID NO: 3829 - RNA, 21 nt, Artificial Sequence
  Description of Artificial Sequence: Synthetic oligonucleotide
  modified_base (20)..(21): 2'-methoxy-nucleotide
ccccaauacuccaaguacauu

SEQ ID NO: 3830 - RNA, 21 nt, Artificial Sequence
  Description of Artificial Sequence: Synthetic oligonucleotide
  modified_base (20)..(21): 2'-methoxy-nucleotide
accccaauacuccaaguacuu

SEQ ID NO: 3831 - RNA, 21 nt, Artificial Sequence
  Description of Artificial Sequence: Synthetic oligonucleotide
  modified_base (20)..(21): 2'-methoxy-nucleotide
gaccccaauacuccaaguauu

SEQ ID NO: 3832 - RNA, 21 nt, Artificial Sequence
  Description of Artificial Sequence: Synthetic oligonucleotide
  modified_base (20)..(21): 2'-methoxy-nucleotide
agaccccaauacuccaaguuu

SEQ ID NO: 3833 - RNA, 21 nt, Artificial Sequence
  Description of Artificial Sequence: Synthetic oligonucleotide
  modified_base (20)..(21): 2'-methoxy-nucleotide
cagaccccaauacuccaaguu

SEQ ID NO: 3834 - RNA, 21 nt, Artificial Sequence
  Description of Artificial Sequence: Synthetic oligonucleotide
  modified_base (20)..(21): 2'-methoxy-nucleotide
ucagaccccaauacuccaauu

SEQ ID NO: 3835 - RNA, 21 nt, Artificial Sequence
  Description of Artificial Sequence: Synthetic oligonucleotide
  modified_base (20)..(21): 2'-methoxy-nucleotide
gucagaccccaauacuccauu

SEQ ID NO: 3836 - RNA, 21 nt, Artificial Sequence
  Description of Artificial Sequence: Synthetic oligonucleotide
  modified_base (20)..(21): 2'-methoxy-nucleotide
ggucagaccccaauacuccuu

SEQ ID NO: 3837 - RNA, 21 nt, Artificial Sequence
  Description of Artificial Sequence: Synthetic oligonucleotide
  modified_base (20)..(21): 2'-methoxy-nucleotide
gggucagaccccaauacucuu

SEQ ID NO: 3838 - RNA, 21 nt, Artificial Sequence
  Description of Artificial Sequence: Synthetic oligonucleotide
  modified_base (20)..(21): 2'-methoxy-nucleotide
ggggucagaccccaauacuuu

SEQ ID NO: 3839 - RNA, 21 nt, Artificial Sequence
  Description of Artificial Sequence: Synthetic oligonucleotide
  modified_base (20)..(21): 2'-methoxy-nucleotide
uggggucagaccccaauacuu

SEQ ID NO: 3840 - RNA, 21 nt, Artificial Sequence
  Description of Artificial Sequence: Synthetic oligonucleotide
  modified_base (20)..(21): 2'-methoxy-nucleotide
uuggggucagaccccaauauu

SEQ ID NO: 3841 - RNA, 21 nt, Artificial Sequence
  Description of Artificial Sequence: Synthetic oligonucleotide
  modified_base (20)..(21): 2'-methoxy-nucleotide
uuuggggucagaccccaauuu

SEQ ID NO: 3842 - RNA, 21 nt, Artificial Sequence
  Description of Artificial Sequence: Synthetic oligonucleotide
  modified_base (20)..(21): 2'-methoxy-nucleotide
guuuggggucagaccccaauu

SEQ ID NO: 3843 - RNA, 21 nt, Artificial Sequence
  Description of Artificial Sequence: Synthetic oligonucleotide
  modified_base (20)..(21): 2'-methoxy-nucleotide
uguuuggggucagaccccauu

SEQ ID NO: 3844 - RNA, 21 nt, Artificial Sequence
  Description of Artificial Sequence: Synthetic oligonucleotide
  modified_base (20)..(21): 2'-methoxy-nucleotide
guguuuggggucagaccccuu

SEQ ID NO: 3845 - RNA, 21 nt, Artificial Sequence
  Description of Artificial Sequence: Synthetic oligonucleotide
  modified_base (20)..(21): 2'-methoxy-nucleotide
gguguuuggggucagacccuu

SEQ ID NO: 3846 - RNA, 21 nt, Artificial Sequence
  Description of Artificial Sequence: Synthetic oligonucleotide
  modified_base (20)..(21): 2'-methoxy-nucleotide
agguguuuggggucagaccuu

SEQ ID NO: 3847 - RNA, 21 nt, Artificial Sequence
  Description of Artificial Sequence: Synthetic oligonucleotide
  modified_base (20)..(21): 2'-methoxy-nucleotide
aagguguuuggggucagacuu

SEQ ID NO: 3848 - RNA, 21 nt, Artificial Sequence
  Description of Artificial Sequence: Synthetic oligonucleotide
  modified_base (20)..(21): 2'-methoxy-nucleotide
gaagguguuuggggucagauu

SEQ ID NO: 3849 - RNA, 21 nt, Artificial Sequence
  Description of Artificial Sequence: Synthetic oligonucleotide
  modified_base (20)..(21): 2'-methoxy-nucleotide
ggaagguguuuggggucaguu

SEQ ID NO: 3850 - RNA, 21 nt, Artificial Sequence
  Description of Artificial Sequence: Synthetic oligonucleotide
  modified_base (20)..(21): 2'-methoxy-nucleotide
uggaagguguuuggggucauu

SEQ ID NO: 3851 - RNA, 21 nt, Artificial Sequence
  Description of Artificial Sequence: Synthetic oligonucleotide
  modified_base (20)..(21): 2'-methoxy-nucleotide
cuggaagguguuuggggucuu

SEQ ID NO: 3852 - RNA, 21 nt, Artificial Sequence
  Description of Artificial Sequence: Synthetic oligonucleotide
  modified_base (20)..(21): 2'-methoxy-nucleotide
gcuggaagguguuugggguuu

SEQ ID NO: 3853 - RNA, 21 nt, Artificial Sequence
  Description of Artificial Sequence: Synthetic oligonucleotide
  modified_base (20)..(21): 2'-methoxy-nucleotide
agcuggaagguguuugggguu

SEQ ID NO: 3854 - RNA, 21 nt, Artificial Sequence
  Description of Artificial Sequence: Synthetic oligonucleotide
  modified_base (20)..(21): 2'-methoxy-nucleotide
gagcuggaagguguuuggguu

SEQ ID NO: 3855 - RNA, 21 nt, Artificial Sequence
  Description of Artificial Sequence: Synthetic oligonucleotide
  modified_base (20)..(21): 2'-methoxy-nucleotide
ggagcuggaagguguuugguu

SEQ ID NO: 3856 - RNA, 21 nt, Artificial Sequence
  Description of Artificial Sequence: Synthetic oligonucleotide
  modified_base (20)..(21): 2'-methoxy-nucleotide
aggagcuggaagguguuuguu

SEQ ID NO: 3857 - RNA, 21 nt, Artificial Sequence
  Description of Artificial Sequence: Synthetic oligonucleotide
  modified_base (20)..(21): 2'-methoxy-nucleotide
caggagcuggaagguguuuuu

SEQ ID NO: 3858 - RNA, 21 nt, Artificial Sequence
  Description of Artificial Sequence: Synthetic oligonucleotide
  modified_base (20)..(21): 2'-methoxy-nucleotide
acaggagcuggaagguguuuu

SEQ ID NO: 3859 - RNA, 21 nt, Artificial Sequence
  Description of Artificial Sequence: Synthetic oligonucleotide
  modified_base (20)..(21): 2'-methoxy-nucleotide
uacaggagcuggaagguguuu

SEQ ID NO: 3860 - RNA, 21 nt, Artificial Sequence
  Description of Artificial Sequence: Synthetic oligonucleotide
  modified_base (20)..(21): 2'-methoxy-nucleotide
uuacaggagcuggaagguguu

SEQ ID NO: 3861 - RNA, 21 nt, Artificial Sequence
  Description of Artificial Sequence: Synthetic oligonucleotide
  modified_base (20)..(21): 2'-methoxy-nucleotide
guuacaggagcuggaagguuu

SEQ ID NO: 3862 - RNA, 21 nt, Artificial Sequence
  Description of Artificial Sequence: Synthetic oligonucleotide
  modified_base (20)..(21): 2'-methoxy-nucleotide
uguuacaggagcuggaagguu

SEQ ID NO: 3863 - RNA, 21 nt, Artificial Sequence
  Description of Artificial Sequence: Synthetic oligonucleotide
  modified_base (20)..(21): 2'-methoxy-nucleotide
auguuacaggagcuggaaguu

SEQ ID NO: 3864 - RNA, 21 nt, Artificial Sequence
  Description of Artificial Sequence: Synthetic oligonucleotide
  modified_base (20)..(21): 2'-methoxy-nucleotide
uauguuacaggagcuggaauu

SEQ ID NO: 3865 - RNA, 21 nt, Artificial Sequence
  Description of Artificial Sequence: Synthetic oligonucleotide
  modified_base (20)..(21): 2'-methoxy-nucleotide
guauguuacaggagcuggauu

SEQ ID NO: 3866 - RNA, 21 nt, Artificial Sequence
  Description of Artificial Sequence: Synthetic oligonucleotide
  modified_base (20)..(21): 2'-methoxy-nucleotide
aguauguuacaggagcugguu

SEQ ID NO: 3867 - RNA, 21 nt, Artificial Sequence
  Description of Artificial Sequence: Synthetic oligonucleotide
  modified_base (20)..(21): 2'-methoxy-nucleotide
caguauguuacaggagcuguu

SEQ ID NO: 3868 - RNA, 21 nt, Artificial Sequence
  Description of Artificial Sequence: Synthetic oligonucleotide
  modified_base (20)..(21): 2'-methoxy-nucleotide
ccaguauguuacaggagcuuu

SEQ ID NO: 3869 - RNA, 21 nt, Artificial Sequence
  Description of Artificial Sequence: Synthetic oligonucleotide
  modified_base (20)..(21): 2'-methoxy-nucleotide
gccaguauguuacaggagcuu

SEQ ID NO: 3870 - RNA, 21 nt, Artificial Sequence
  Description of Artificial Sequence: Synthetic oligonucleotide
  modified_base (20)..(21): 2'-methoxy-nucleotide
ggccaguauguuacaggaguu

SEQ ID NO: 3871 - RNA, 21 nt, Artificial Sequence
  Description of Artificial Sequence: Synthetic oligonucleotide
  modified_base (20)..(21): 2'-methoxy-nucleotide
aggccaguauguuacaggauu

SEQ ID NO: 3872 - RNA, 21 nt, Artificial Sequence
  Description of Artificial Sequence: Synthetic oligonucleotide
  modified_base (20)..(21): 2'-methoxy-nucleotide
caggccaguauguuacagguu

SEQ ID NO: 3873 - RNA, 21 nt, Artificial Sequence
  Description of Artificial Sequence: Synthetic oligonucleotide
  modified_base (20)..(21): 2'-methoxy-nucleotide
ccaggccaguauguuacaguu

SEQ ID NO: 3874 - RNA, 21 nt, Artificial Sequence
  Description of Artificial Sequence: Synthetic oligonucleotide
  modified_base (20)..(21): 2'-methoxy-nucleotide
uccaggccaguauguuacauu

SEQ ID NO: 3875 - RNA, 21 nt, Artificial Sequence
  Description of Artificial Sequence: Synthetic oligonucleotide
  modified_base (20)..(21): 2'-methoxy-nucleotide
guccaggccaguauguuacuu

SEQ ID NO: 3876 - RNA, 21 nt, Artificial Sequence
  Description of Artificial Sequence: Synthetic oligonucleotide
  modified_base (20)..(21): 2'-methoxy-nucleotide
aguccaggccaguauguuauu

SEQ ID NO: 3877 - RNA, 21 nt, Artificial Sequence
  Description of Artificial Sequence: Synthetic oligonucleotide
  modified_base (20)..(21): 2'-methoxy-nucleotide
caguccaggccaguauguuuu

SEQ ID NO: 3878 - RNA, 21 nt, Artificial Sequence
  Description of Artificial Sequence: Synthetic oligonucleotide
  modified_base (20)..(21): 2'-methoxy-nucleotide
acaguccaggccaguauguuu

SEQ ID NO: 3879 - RNA, 21 nt, Artificial Sequence
  Description of Artificial Sequence: Synthetic oligonucleotide
  modified_base (20)..(21): 2'-methoxy-nucleotide
aacaguccaggccaguauguu

SEQ ID NO: 3880 - RNA, 21 nt, Artificial Sequence
  Description of Artificial Sequence: Synthetic oligonucleotide
  modified_base (20)..(21): 2'-methoxy-nucleotide
aaacaguccaggccaguauuu

SEQ ID NO: 3881 - RNA, 21 nt, Artificial Sequence
  Description of Artificial Sequence: Synthetic oligonucleotide
  modified_base (20)..(21): 2'-methoxy-nucleotide
aaaacaguccaggccaguauu

SEQ ID NO: 3882 - RNA, 21 nt, Artificial Sequence
  Description of Artificial Sequence: Synthetic oligonucleotide
  modified_base (20)..(21): 2'-methoxy-nucleotide
gaaaacaguccaggccaguuu

SEQ ID NO: 3883 - RNA, 21 nt, Artificial Sequence
  Description of Artificial Sequence: Synthetic oligonucleotide
  modified_base (20)..(21): 2'-methoxy-nucleotide
agaaaacaguccaggccaguu

SEQ ID NO: 3884 - RNA, 21 nt, Artificial Sequence
  Description of Artificial Sequence: Synthetic oligonucleotide
  modified_base (20)..(21): 2'-methoxy-nucleotide
gagaaaacaguccaggccauu

SEQ ID NO: 3885 - RNA, 21 nt, Artificial Sequence
  Description of Artificial Sequence: Synthetic oligonucleotide
  modified_base (20)..(21): 2'-methoxy-nucleotide
agagaaaacaguccaggccuu

SEQ ID NO: 3886 - RNA, 21 nt, Artificial Sequence
  Description of Artificial Sequence: Synthetic oligonucleotide
  modified_base (20)..(21): 2'-methoxy-nucleotide
gagagaaaacaguccaggcuu

SEQ ID NO: 3887 - RNA, 21 nt, Artificial Sequence
  Description of Artificial Sequence: Synthetic oligonucleotide
  modified_base (20)..(21): 2'-methoxy-nucleotide
cgagagaaaacaguccagguu

SEQ ID NO: 3888 - RNA, 21 nt, Artificial Sequence
  Description of Artificial Sequence: Synthetic oligonucleotide
  modified_base (20)..(21): 2'-methoxy-nucleotide
ccgagagaaaacaguccaguu

SEQ ID NO: 3889 - RNA, 21 nt, Artificial Sequence
  Description of Artificial Sequence: Synthetic oligonucleotide
  modified_base (20)..(21): 2'-methoxy-nucleotide
gccgagagaaaacaguccauu

SEQ ID NO: 3890 - RNA, 21 nt, Artificial Sequence
  Description of Artificial Sequence: Synthetic oligonucleotide
  modified_base (20)..(21): 2'-methoxy-nucleotide
agccgagagaaaacaguccuu

SEQ ID NO: 3891 - RNA, 21 nt, Artificial Sequence
  Description of Artificial Sequence: Synthetic oligonucleotide
  modified_base (20)..(21): 2'-methoxy-nucleotide
gagccgagagaaaacagucuu

SEQ ID NO: 3892 - RNA, 21 nt, Artificial Sequence
  Description of Artificial Sequence: Synthetic oligonucleotide
  modified_base (20)..(21): 2'-methoxy-nucleotide
ggagccgagagaaaacaguuu

SEQ ID NO: 3893 - RNA, 21 nt, Artificial Sequence
  Description of Artificial Sequence: Synthetic oligonucleotide
  modified_base (20)..(21): 2'-methoxy-nucleotide
gggagccgagagaaaacaguu

SEQ ID NO: 3894 - RNA, 21 nt, Artificial Sequence
  Description of Artificial Sequence: Synthetic oligonucleotide
  modified_base (20)..(21): 2'-methoxy-nucleotide
ggggagccgagagaaaacauu

SEQ ID NO: 3895 - RNA, 21 nt, Artificial Sequence
  Description of Artificial Sequence: Synthetic oligonucleotide
  modified_base (20)..(21): 2'-methoxy-nucleotide
uggggagccgagagaaaacuu

SEQ ID NO: 3896 - RNA, 21 nt, Artificial Sequence
  Description of Artificial Sequence: Synthetic oligonucleotide
  modified_base (20)..(21): 2'-methoxy-nucleotide
auggggagccgagagaaaauu

SEQ ID NO: 3897 - RNA, 21 nt, Artificial Sequence
  Description of Artificial Sequence: Synthetic oligonucleotide
  modified_base (20)..(21): 2'-methoxy-nucleotide
cauggggagccgagagaaauu

SEQ ID NO: 3898 - RNA, 21 nt, Artificial Sequence
  Description of Artificial Sequence: Synthetic oligonucleotide
  modified_base (20)..(21): 2'-methoxy-nucleotide
acauggggagccgagagaauu

SEQ ID NO: 3899 - RNA, 21 nt, Artificial Sequence
  Description of Artificial Sequence: Synthetic oligonucleotide
  modified_base (20)..(21): 2'-methoxy-nucleotide
cacauggggagccgagagauu

SEQ ID NO: 3900 - RNA, 21 nt, Artificial Sequence
  Description of Artificial Sequence: Synthetic oligonucleotide
  modified_base (20)..(21): 2'-methoxy-nucleotide
acacauggggagccgagaguu

SEQ ID NO: 3901 - RNA, 21 nt, Artificial Sequence
  Description of Artificial Sequence: Synthetic oligonucleotide
  modified_base (20)..(21): 2'-methoxy-nucleotide
gacacauggggagccgagauu

SEQ ID NO: 3902 - RNA, 21 nt, Artificial Sequence
  Description of Artificial Sequence: Synthetic oligonucleotide
  modified_base (20)..(21): 2'-methoxy-nucleotide
ggacacauggggagccgaguu

SEQ ID NO: 3903 - RNA, 21 nt, Artificial Sequence
  Description of Artificial Sequence: Synthetic oligonucleotide
  modified_base (20)..(21): 2'-methoxy-nucleotide
aggacacauggggagccgauu

SEQ ID NO: 3904 - RNA, 21 nt, Artificial Sequence
  Description of Artificial Sequence: Synthetic oligonucleotide
  modified_base (20)..(21): 2'-methoxy-nucleotide
caggacacauggggagccguu

SEQ ID NO: 3905 - RNA, 21 nt, Artificial Sequence
  Description of Artificial Sequence: Synthetic oligonucleotide
  modified_base (20)..(21): 2'-methoxy-nucleotide
ccaggacacauggggagccuu

SEQ ID NO: 3906 - RNA, 21 nt, Artificial Sequence
  Description of Artificial Sequence: Synthetic oligonucleotide
  modified_base (20)..(21): 2'-methoxy-nucleotide
accaggacacauggggagcuu

SEQ ID NO: 3907 - RNA, 21 nt, Artificial Sequence
  Description of Artificial Sequence: Synthetic oligonucleotide
  modified_base (20)..(21): 2'-methoxy-nucleotide
aaccaggacacauggggaguu

SEQ ID NO: 3908 - RNA, 21 nt, Artificial Sequence
  Description of Artificial Sequence: Synthetic oligonucleotide
  modified_base (20)..(21): 2'-methoxy-nucleotide
gaaccaggacacauggggauu

SEQ ID NO: 3909 - RNA, 21 nt, Artificial Sequence
  Description of Artificial Sequence: Synthetic oligonucleotide
  modified_base (20)..(21): 2'-methoxy-nucleotide
ggaaccaggacacaugggguu

SEQ ID NO: 3910 - RNA, 21 nt, Artificial Sequence
  Description of Artificial Sequence: Synthetic oligonucleotide
  modified_base (20)..(21): 2'-methoxy-nucleotide
gggaaccaggacacauggguu

SEQ ID NO: 3911 - RNA, 21 nt, Artificial Sequence
  Description of Artificial Sequence: Synthetic oligonucleotide
  modified_base (20)..(21): 2'-methoxy-nucleotide
cgggaaccaggacacaugguu

SEQ ID NO: 3912 - RNA, 21 nt, Artificial Sequence
  Description of Artificial Sequence: Synthetic oligonucleotide
  modified_base (20)..(21): 2'-methoxy-nucleotide
acgggaaccaggacacauguu

SEQ ID NO: 3913 - RNA, 21 nt, Artificial Sequence
  Description of Artificial Sequence: Synthetic oligonucleotide
  modified_base (20)..(21): 2'-methoxy-nucleotide
aacgggaaccaggacacauuu

SEQ ID NO: 3914 - RNA, 21 nt, Artificial Sequence
  Description of Artificial Sequence: Synthetic oligonucleotide
  modified_base (20)..(21): 2'-methoxy-nucleotide
aaacgggaaccaggacacauu

SEQ ID NO: 3915 - RNA, 21 nt, Artificial Sequence
  Description of Artificial Sequence: Synthetic oligonucleotide
  modified_base (20)..(21): 2'-methoxy-nucleotide
gaaacgggaaccaggacacuu

SEQ ID NO: 3916 - RNA, 21 nt, Artificial Sequence
  Description of Artificial Sequence: Synthetic oligonucleotide
  modified_base (20)..(21): 2'-methoxy-nucleotide
agaaacgggaaccaggacauu

SEQ ID NO: 3917 - RNA, 21 nt, Artificial Sequence
  Description of Artificial Sequence: Synthetic oligonucleotide
  modified_base (20)..(21): 2'-methoxy-nucleotide
gagaaacgggaaccaggacuu

SEQ ID NO: 3918 - RNA, 21 nt, Artificial Sequence
  Description of Artificial Sequence: Synthetic oligonucleotide
  modified_base (20)..(21): 2'-methoxy-nucleotide
ggagaaacgggaaccaggauu

SEQ ID NO: 3919 - RNA, 21 nt, Artificial Sequence
  Description of Artificial Sequence: Synthetic oligonucleotide
  modified_base (20)..(21): 2'-methoxy-nucleotide
uggagaaacgggaaccagguu

SEQ ID NO: 3920 - RNA, 21 nt, Artificial Sequence
  Description of Artificial Sequence: Synthetic oligonucleotide
  modified_base (20)..(21): 2'-methoxy-nucleotide
guggagaaacgggaaccaguu

SEQ ID NO: 3921 - RNA, 21 nt, Artificial Sequence
  Description of Artificial Sequence: Synthetic oligonucleotide
  modified_base (20)..(21): 2'-methoxy-nucleotide
gguggagaaacgggaaccauu

SEQ ID NO: 3922 - RNA, 21 nt, Artificial Sequence
  Description of Artificial Sequence: Synthetic oligonucleotide
  modified_base (20)..(21): 2'-methoxy-nucleotide
agguggagaaacgggaaccuu

SEQ ID NO: 3923 - RNA, 21 nt, Artificial Sequence
  Description of Artificial Sequence: Synthetic oligonucleotide
  modified_base (20)..(21): 2'-methoxy-nucleotide
uagguggagaaacgggaacuu

SEQ ID NO: 3924 - RNA, 21 nt, Artificial Sequence
  Description of Artificial Sequence: Synthetic oligonucleotide
  modified_base (20)..(21): 2'-methoxy-nucleotide
cuagguggagaaacgggaauu

SEQ ID NO: 3925 - RNA, 21 nt, Artificial Sequence
  Description of Artificial Sequence: Synthetic oligonucleotide
  modified_base (20)..(21): 2'-methoxy-nucleotide
ucuagguggagaaacgggauu

SEQ ID NO: 3926 - RNA, 21 nt, Artificial Sequence
  Description of Artificial Sequence: Synthetic oligonucleotide
  modified_base (20)..(21): 2'-methoxy-nucleotide
gucuagguggagaaacggguu

SEQ ID NO: 3927 - RNA, 21 nt, Artificial Sequence
  Description of Artificial Sequence: Synthetic oligonucleotide
  modified_base (20)..(21): 2'-methoxy-nucleotide
agucuagguggagaaacgguu

SEQ ID NO: 3928 - RNA, 21 nt, Artificial Sequence
  Description of Artificial Sequence: Synthetic oligonucleotide
  modified_base (20)..(21): 2'-methoxy-nucleotide
cagucuagguggagaaacguu

SEQ ID NO: 3929 - RNA, 21 nt, Artificial Sequence
  Description of Artificial Sequence: Synthetic oligonucleotide
  modified_base (20)..(21): 2'-methoxy-nucleotide
acagucuagguggagaaacuu

SEQ ID NO: 3930 - RNA, 21 nt, Artificial Sequence
  Description of Artificial Sequence: Synthetic oligonucleotide
  modified_base (20)..(21): 2'-methoxy-nucleotide
uacagucuagguggagaaauu

SEQ ID NO: 3931 - RNA, 21 nt, Artificial Sequence
  Description of Artificial Sequence: Synthetic oligonucleotide
  modified_base (20)..(21): 2'-methoxy-nucleotide
uuacagucuagguggagaauu

SEQ ID NO: 3932 - RNA, 21 nt, Artificial Sequence
  Description of Artificial Sequence: Synthetic oligonucleotide
  modified_base (20)..(21): 2'-methoxy-nucleotide
uuuacagucuagguggagauu

SEQ ID NO: 3933 - RNA, 21 nt, Artificial Sequence
  Description of Artificial Sequence: Synthetic oligonucleotide
  modified_base (20)..(21): 2'-methoxy-nucleotide
guuuacagucuagguggaguu

SEQ ID NO: 3934 - RNA, 21 nt, Artificial Sequence
  Description of Artificial Sequence: Synthetic oligonucleotide
  modified_base (20)..(21): 2'-methoxy-nucleotide
gguuuacagucuagguggauu

SEQ ID NO: 3935 - RNA, 21 nt, Artificial Sequence
  Description of Artificial Sequence: Synthetic oligonucleotide
  modified_base (20)..(21): 2'-methoxy-nucleotide
agguuuacagucuaggugguu

SEQ ID NO: 3936 - RNA, 21 nt, Artificial Sequence
  Description of Artificial Sequence: Synthetic oligonucleotide
  modified_base (20)..(21): 2'-methoxy-nucleotide
gagguuuacagucuagguguu

SEQ ID NO: 3937 - RNA, 21 nt, Artificial Sequence
  Description of Artificial Sequence: Synthetic oligonucleotide
  modified_base (20)..(21): 2'-methoxy-nucleotide
agagguuuacagucuagguuu

SEQ ID NO: 3938 - RNA, 21 nt, Artificial Sequence
  Description of Artificial Sequence: Synthetic oligonucleotide
  modified_base (20)..(21): 2'-methoxy-nucleotide
gagagguuuacagucuagguu

SEQ ID NO: 3939 - RNA, 21 nt, Artificial Sequence
  Description of Artificial Sequence: Synthetic oligonucleotide
  modified_base (20)..(21): 2'-methoxy-nucleotide
cgagagguuuacagucuaguu

SEQ ID NO: 3940 - RNA, 21 nt, Artificial Sequence
  Description of Artificial Sequence: Synthetic oligonucleotide
  modified_base (20)..(21): 2'-methoxy-nucleotide
ucgagagguuuacagucuauu

SEQ ID NO: 3941 - RNA, 21 nt, Artificial Sequence
  Description of Artificial Sequence: Synthetic oligonucleotide
  modified_base (20)..(21): 2'-methoxy-nucleotide
cucgagagguuuacagucuuu

SEQ ID NO: 3942 - RNA, 21 nt, Artificial Sequence
  Description of Artificial Sequence: Synthetic oligonucleotide
  modified_base (20)..(21): 2'-methoxy-nucleotide
ccucgagagguuuacagucuu

SEQ ID NO: 3943 - RNA, 21 nt, Artificial Sequence
  Description of Artificial Sequence: Synthetic oligonucleotide
  modified_base (20)..(21): 2'-methoxy-nucleotide
cccucgagagguuuacaguuu

SEQ ID NO: 3944 - RNA, 21 nt, Artificial Sequence
  Description of Artificial Sequence: Synthetic oligonucleotide
  modified_base (20)..(21): 2'-methoxy-nucleotide
gcccucgagagguuuacaguu

SEQ ID NO: 3945 - RNA, 21 nt, Artificial Sequence
  Description of Artificial Sequence: Synthetic oligonucleotide
  modified_base (20)..(21): 2'-methoxy-nucleotide
ugcccucgagagguuuacauu

SEQ ID NO: 3946 - RNA, 21 nt, Artificial Sequence
  Description of Artificial Sequence: Synthetic oligonucleotide
  modified_base (20)..(21): 2'-methoxy-nucleotide
cugcccucgagagguuuacuu

SEQ ID NO: 3947 - RNA, 21 nt, Artificial Sequence
  Description of Artificial Sequence: Synthetic oligonucleotide
  modified_base (20)..(21): 2'-methoxy-nucleotide
ccugcccucgagagguuuauu

SEQ ID NO: 3948 - RNA, 21 nt, Artificial Sequence
  Description of Artificial Sequence: Synthetic oligonucleotide
  modified_base (20)..(21): 2'-methoxy-nucleotide
cccugcccucgagagguuuuu

SEQ ID NO: 3949 - RNA, 21 nt, Artificial Sequence
  Description of Artificial Sequence: Synthetic oligonucleotide
  modified_base (20)..(21): 2'-methoxy-nucleotide
ucccugcccucgagagguuuu

SEQ ID NO: 3950 - RNA, 21 nt, Artificial Sequence
  Description of Artificial Sequence: Synthetic oligonucleotide
  modified_base (20)..(21): 2'-methoxy-nucleotide
gucccugcccucgagagguuu

SEQ ID NO: 3951 - RNA, 21 nt, Artificial Sequence
  Description of Artificial Sequence: Synthetic oligonucleotide
  modified_base (20)..(21): 2'-methoxy-nucleotide
ggucccugcccucgagagguu

SEQ ID NO: 3952 - RNA, 21 nt, Artificial Sequence
  Description of Artificial Sequence: Synthetic oligonucleotide
  modified_base (20)..(21): 2'-methoxy-nucleotide
uggucccugcccucgagaguu

SEQ ID NO: 3953 - RNA, 21 nt, Artificial Sequence
  Description of Artificial Sequence: Synthetic oligonucleotide
  modified_base (20)..(21): 2'-methoxy-nucleotide
guggucccugcccucgagauu

SEQ ID NO: 3954 - RNA, 21 nt, Artificial Sequence
  Description of Artificial Sequence: Synthetic oligonucleotide
  modified_base (20)..(21): 2'-methoxy-nucleotide
uguggucccugcccucgaguu

SEQ ID NO: 3955 - RNA, 21 nt, Artificial Sequence
  Description of Artificial Sequence: Synthetic oligonucleotide
  modified_base (20)..(21): 2'-methoxy-nucleotide
guguggucccugcccucgauu

SEQ ID NO: 3956 - RNA, 21 nt, Artificial Sequence
  Description of Artificial Sequence: Synthetic oligonucleotide
  modified_base (20)..(21): 2'-methoxy-nucleotide
gguguggucccugcccucguu

SEQ ID NO: 3957 - RNA, 21 nt, Artificial Sequence
  Description of Artificial Sequence: Synthetic oligonucleotide
  modified_base (20)..(21): 2'-methoxy-nucleotide
ggguguggucccugcccucuu

SEQ ID NO: 3958 - RNA, 21 nt, Artificial Sequence
  Description of Artificial Sequence: Synthetic oligonucleotide
  modified_base (20)..(21): 2'-methoxy-nucleotide
aggguguggucccugcccuuu

SEQ ID NO: 3959 - RNA, 21 nt, Artificial Sequence
  Description of Artificial Sequence: Synthetic oligonucleotide
  modified_base (20)..(21): 2'-methoxy-nucleotide
caggguguggucccugcccuu

SEQ ID NO: 3960 - RNA, 21 nt, Artificial Sequence
  Description of Artificial Sequence: Synthetic oligonucleotide
  modified_base (20)..(21): 2'-methoxy-nucleotide
acaggguguggucccugccuu

SEQ ID NO: 3961 - RNA, 21 nt, Artificial Sequence
  Description of Artificial Sequence: Synthetic oligonucleotide
  modified_base (20)..(21): 2'-methoxy-nucleotide
uacaggguguggucccugcuu

SEQ ID NO: 3962 - RNA, 21 nt, Artificial Sequence
  Description of Artificial Sequence: Synthetic oligonucleotide
  modified_base (20)..(21): 2'-methoxy-nucleotide
guacaggguguggucccuguu

SEQ ID NO: 3963 - RNA, 21 nt, Artificial Sequence
  Description of Artificial Sequence: Synthetic oligonucleotide
  modified_base (20)..(21): 2'-methoxy-nucleotide
aguacaggguguggucccuuu

SEQ ID NO: 3964 - RNA, 21 nt, Artificial Sequence
  Description of Artificial Sequence: Synthetic oligonucleotide
  modified_base (20)..(21): 2'-methoxy-nucleotide
caguacaggguguggucccuu

SEQ ID NO: 3965 - RNA, 21 nt, Artificial Sequence
  Description of Artificial Sequence: Synthetic oligonucleotide
  modified_base (20)..(21): 2'-methoxy-nucleotide
acaguacagggugugguccuu

SEQ ID NO: 3966 - RNA, 21 nt, Artificial Sequence
  Description of Artificial Sequence: Synthetic oligonucleotide
  modified_base (20)..(21): 2'-methoxy-nucleotide
aacaguacaggguguggucuu

SEQ ID NO: 3967 - RNA, 21 nt, Artificial Sequence
  Description of Artificial Sequence: Synthetic oligonucleotide
  modified_base (20)..(21): 2'-methoxy-nucleotide
gaacaguacagggugugguuu

SEQ ID NO: 3968 - RNA, 21 nt, Artificial Sequence
  Description of Artificial Sequence: Synthetic oligonucleotide
  modified_base (20)..(21): 2'-methoxy-nucleotide
agaacaguacagggugugguu

SEQ ID NO: 3969 - RNA, 21 nt, Artificial Sequence
  Description of Artificial Sequence: Synthetic oligonucleotide
  modified_base (20)..(21): 2'-methoxy-nucleotide
cagaacaguacaggguguguu

SEQ ID NO: 3970 - RNA, 21 nt, Artificial Sequence
  Description of Artificial Sequence: Synthetic oligonucleotide
  modified_base (20)..(21): 2'-methoxy-nucleotide
acagaacaguacaggguguuu

SEQ ID NO: 3971 - RNA, 21 nt, Artificial Sequence
  Description of Artificial Sequence: Synthetic oligonucleotide
  modified_base (20)..(21): 2'-methoxy-nucleotide
cacagaacaguacaggguguu

SEQ ID NO: 3972 - RNA, 21 nt, Artificial Sequence
  Description of Artificial Sequence: Synthetic oligonucleotide
  modified_base (20)..(21): 2'-methoxy-nucleotide
acacagaacaguacaggguuu

SEQ ID NO: 3973 - RNA, 21 nt, Artificial Sequence
  Description of Artificial Sequence: Synthetic oligonucleotide
  modified_base (20)..(21): 2'-methoxy-nucleotide
gacacagaacaguacaggguu

SEQ ID NO: 3974 - RNA, 21 nt, Artificial Sequence
  Description of Artificial Sequence: Synthetic oligonucleotide
  modified_base (20)..(21): 2'-methoxy-nucleotide
agacacagaacaguacagguu

SEQ ID NO: 3975 - RNA, 21 nt, Artificial Sequence
  Description of Artificial Sequence: Synthetic oligonucleotide
  modified_base (20)..(21): 2'-methoxy-nucleotide
aagacacagaacaguacaguu

SEQ ID NO: 3976 - RNA, 21 nt, Artificial Sequence
  Description of Artificial Sequence: Synthetic oligonucleotide
  modified_base (20)..(21): 2'-methoxy-nucleotide
aaagacacagaacaguacauu

SEQ ID NO: 3977 - RNA, 21 nt, Artificial Sequence
  Description of Artificial Sequence: Synthetic oligonucleotide
  modified_base (20)..(21): 2'-methoxy-nucleotide
gaaagacacagaacaguacuu

SEQ ID NO: 3978 - RNA, 21 nt, Artificial Sequence
  Description of Artificial Sequence: Synthetic oligonucleotide
  modified_base (20)..(21): 2'-methoxy-nucleotide
ugaaagacacagaacaguauu

SEQ ID NO: 3979 - RNA, 21 nt, Artificial Sequence
  Description of Artificial Sequence: Synthetic oligonucleotide
  modified_base (20)..(21): 2'-methoxy-nucleotide
gugaaagacacagaacaguuu

SEQ ID NO: 3980 - RNA, 21 nt, Artificial Sequence
  Description of Artificial Sequence: Synthetic oligonucleotide
  modified_base (20)..(21): 2'-methoxy-nucleotide
ugugaaagacacagaacaguu

SEQ ID NO: 3981 - RNA, 21 nt, Artificial Sequence
  Description of Artificial Sequence: Synthetic oligonucleotide
  modified_base (20)..(21): 2'-methoxy-nucleotide
cugugaaagacacagaacauu

SEQ ID NO: 3982 - RNA, 21 nt, Artificial Sequence
  Description of Artificial Sequence: Synthetic oligonucleotide
  modified_base (20)..(21): 2'-methoxy-nucleotide
gcugugaaagacacagaacuu

SEQ ID NO: 3983 - RNA, 21 nt, Artificial Sequence
  Description of Artificial Sequence: Synthetic oligonucleotide
  modified_base (20)..(21): 2'-methoxy-nucleotide
agcugugaaagacacagaauu

SEQ ID NO: 3984 - RNA, 21 nt, Artificial Sequence
  Description of Artificial Sequence: Synthetic oligonucleotide
  modified_base (20)..(21): 2'-methoxy-nucleotide
gagcugugaaagacacagauu

SEQ ID NO: 3985 - RNA, 21 nt, Artificial Sequence
  Description of Artificial Sequence: Synthetic oligonucleotide
  modified_base (20)..(21): 2'-methoxy-nucleotide
ggagcugugaaagacacaguu

SEQ ID NO: 3986 - RNA, 21 nt, Artificial Sequence
  Description of Artificial Sequence: Synthetic oligonucleotide
  modified_base (20)..(21): 2'-methoxy-nucleotide
aggagcugugaaagacacauu

SEQ ID NO: 3987 - RNA, 21 nt, Artificial Sequence
  Description of Artificial Sequence: Synthetic oligonucleotide
  modified_base (20)..(21): 2'-methoxy-nucleotide
gaggagcugugaaagacacuu

SEQ ID NO: 3988 - RNA, 21 nt, Artificial Sequence
  Description of Artificial Sequence: Synthetic oligonucleotide
  modified_base (20)..(21): 2'-methoxy-nucleotide
ggaggagcugugaaagacauu

SEQ ID NO: 3989 - RNA, 21 nt, Artificial Sequence
  Description of Artificial Sequence: Synthetic oligonucleotide
  modified_base (20)..(21): 2'-methoxy-nucleotide
gggaggagcugugaaagacuu

SEQ ID NO: 3990 - RNA, 21 nt, Artificial Sequence
  Description of Artificial Sequence: Synthetic oligonucleotide
  modified_base (20)..(21): 2'-methoxy-nucleotide
ugggaggagcugugaaagauu

SEQ ID NO: 3991 - RNA, 21 nt, Artificial Sequence
  Description of Artificial Sequence: Synthetic oligonucleotide
  modified_base (20)..(21): 2'-methoxy-nucleotide
gugggaggagcugugaaaguu

SEQ ID NO: 3992 - RNA, 21 nt, Artificial Sequence
  Description of Artificial Sequence: Synthetic oligonucleotide
  modified_base (20)..(21): 2'-methoxy-nucleotide
ugugggaggagcugugaaauu

SEQ ID NO: 3993 - RNA, 21 nt, Artificial Sequence
  Description of Artificial Sequence: Synthetic oligonucleotide
  modified_base (20)..(21): 2'-methoxy-nucleotide
uugugggaggagcugugaauu

SEQ ID NO: 3994 - RNA, 21 nt, Artificial Sequence
  Description of Artificial Sequence: Synthetic oligonucleotide
  modified_base (20)..(21): 2'-methoxy-nucleotide
auugugggaggagcugugauu

SEQ ID NO: 3995 - RNA, 21 nt, Artificial Sequence
  Description of Artificial Sequence: Synthetic oligonucleotide
  modified_base (20)..(21): 2'-methoxy-nucleotide
cauugugggaggagcuguguu

SEQ ID NO: 3996 - RNA, 21 nt, Artificial Sequence
  Description of Artificial Sequence: Synthetic oligonucleotide
  modified_base (20)..(21): 2'-methoxy-nucleotide
gcauugugggaggagcuguuu

SEQ ID NO: 3997 - RNA, 21 nt, Artificial Sequence
  Description of Artificial Sequence: Synthetic oligonucleotide
  modified_base (20)..(21): 2'-methoxy-nucleotide
agcauugugggaggagcuguu

SEQ ID NO: 3998 - RNA, 21 nt, Artificial Sequence
  Description of Artificial Sequence: Synthetic oligonucleotide
  modified_base (20)..(21): 2'-methoxy-nucleotide
cagcauugugggaggagcuuu

SEQ ID NO: 3999 - RNA, 21 nt, Artificial Sequence
  Description of Artificial Sequence: Synthetic oligonucleotide
  modified_base (20)..(21): 2'-methoxy-nucleotide
ucagcauugugggaggagcuu

SEQ ID NO: 4000 - RNA, 21 nt, Artificial Sequence
  Description of Artificial Sequence: Synthetic oligonucleotide
  modified_base (20)..(21): 2'-methoxy-nucleotide
uucagcauugugggaggaguu

SEQ ID NO: 4001 - RNA, 21 nt, Artificial Sequence
  Description of Artificial Sequence: Synthetic oligonucleotide
  modified_base (20)..(21): 2'-methoxy-nucleotide
auucagcauugugggaggauu

SEQ ID NO: 4002 - RNA, 21 nt, Artificial Sequence
  Description of Artificial Sequence: Synthetic oligonucleotide
  modified_base (20)..(21): 2'-methoxy-nucleotide
uauucagcauugugggagguu

SEQ ID NO: 4003 - RNA, 21 nt, Artificial Sequence
  Description of Artificial Sequence: Synthetic oligonucleotide
  modified_base (20)..(21): 2'-methoxy-nucleotide
auauucagcauugugggaguu

SEQ ID NO: 4004 - RNA, 21 nt, Artificial Sequence
  Description of Artificial Sequence: Synthetic oligonucleotide
  modified_base (20)..(21): 2'-methoxy-nucleotide
uauauucagcauugugggauu

SEQ ID NO: 4005 - RNA, 21 nt, Artificial Sequence
  Description of Artificial Sequence: Synthetic oligonucleotide
  modified_base (20)..(21): 2'-methoxy-nucleotide
guauauucagcauuguggguu

SEQ ID NO: 4006 - RNA, 21 nt, Artificial Sequence
  Description of Artificial Sequence: Synthetic oligonucleotide
  modified_base (20)..(21): 2'-methoxy-nucleotide
uguauauucagcauugugguu

SEQ ID NO: 4007 - RNA, 21 nt, Artificial Sequence
  Description of Artificial Sequence: Synthetic oligonucleotide
  modified_base (20)..(21): 2'-methoxy-nucleotide
cuguauauucagcauuguguu

SEQ ID NO: 4008 - RNA, 21 nt, Artificial Sequence
  Description of Artificial Sequence: Synthetic oligonucleotide
  modified_base (20)..(21): 2'-methoxy-nucleotide
gcuguauauucagcauuguuu

SEQ ID NO: 4009 - RNA, 21 nt, Artificial Sequence
  Description of Artificial Sequence: Synthetic oligonucleotide
  modified_base (20)..(21): 2'-methoxy-nucleotide
ugcuguauauucagcauuguu

SEQ ID NO: 4010 - RNA, 21 nt, Artificial Sequence
  Description of Artificial Sequence: Synthetic oligonucleotide
  modified_base (20)..(21): 2'-methoxy-nucleotide
cugcuguauauucagcauuuu

SEQ ID NO: 4011 - RNA, 21 nt, Artificial Sequence
  Description of Artificial Sequence: Synthetic oligonucleotide
  modified_base (20)..(21): 2'-methoxy-nucleotide
ccugcuguauauucagcauuu

SEQ ID NO: 4012 - RNA, 21 nt, Artificial Sequence
  Description of Artificial Sequence: Synthetic oligonucleotide
  modified_base (20)..(21): 2'-methoxy-nucleotide
accugcuguauauucagcauu

SEQ ID NO: 4013 - RNA, 21 nt, Artificial Sequence
  Description of Artificial Sequence: Synthetic oligonucleotide
  modified_base (20)..(21): 2'-methoxy-nucleotide
caccugcuguauauucagcuu

SEQ ID NO: 4014 - RNA, 21 nt, Artificial Sequence
  Description of Artificial Sequence: Synthetic oligonucleotide
  modified_base (20)..(21): 2'-methoxy-nucleotide
gcaccugcuguauauucaguu

SEQ ID NO: 4015 - RNA, 21 nt, Artificial Sequence
  Description of Artificial Sequence: Synthetic oligonucleotide
  modified_base (20)..(21): 2'-methoxy-nucleotide
agcaccugcuguauauucauu

SEQ ID NO: 4016 - RNA, 21 nt, Artificial Sequence
  Description of Artificial Sequence: Synthetic oligonucleotide
  modified_base (20)..(21): 2'-methoxy-nucleotide
gagcaccugcuguauauucuu

SEQ ID NO: 4017 - RNA, 21 nt, Artificial Sequence
  Description of Artificial Sequence: Synthetic oligonucleotide
  modified_base (20)..(21): 2'-methoxy-nucleotide
ugagcaccugcuguauauuuu

SEQ ID NO: 4018 - RNA, 21 nt, Artificial Sequence
  Description of Artificial Sequence: Synthetic oligonucleotide
  modified_base (20)..(21): 2'-methoxy-nucleotide
uugagcaccugcuguauauuu

SEQ ID NO: 4019 - RNA, 21 nt, Artificial Sequence
  Description of Artificial Sequence: Synthetic oligonucleotide
  modified_base (20)..(21): 2'-methoxy-nucleotide
auugagcaccugcuguauauu

SEQ ID NO: 4020 - RNA, 21 nt, Artificial Sequence
  Description of Artificial Sequence: Synthetic oligonucleotide
  modified_base (20)..(21): 2'-methoxy-nucleotide
uauugagcaccugcuguauuu

SEQ ID NO: 4021 - RNA, 21 nt, Artificial Sequence
  Description of Artificial Sequence: Synthetic oligonucleotide
  modified_base (20)..(21): 2'-methoxy-nucleotide
uuauugagcaccugcuguauu

SEQ ID NO: 4022 - RNA, 21 nt, Artificial Sequence
  Description of Artificial Sequence: Synthetic oligonucleotide
  modified_base (20)..(21): 2'-methoxy-nucleotide
uuuauugagcaccugcuguuu

SEQ ID NO: 4023 - RNA, 21 nt, Artificial Sequence
  Description of Artificial Sequence: Synthetic oligonucleotide
  modified_base (20)..(21): 2'-methoxy-nucleotide
auuuauugagcaccugcuguu

SEQ ID NO: 4024 - RNA, 21 nt, Artificial Sequence
  Description of Artificial Sequence: Synthetic oligonucleotide
  modified_base (20)..(21): 2'-methoxy-nucleotide
cauuuauugagcaccugcuuu

SEQ ID NO: 4025 - RNA, 21 nt, Artificial Sequence
  Description of Artificial Sequence: Synthetic oligonucleotide
  modified_base (20)..(21): 2'-methoxy-nucleotide
ucauuuauugagcaccugcuu

SEQ ID NO: 4026 - RNA, 21 nt, Artificial Sequence
  Description of Artificial Sequence: Synthetic oligonucleotide
  modified_base (20)..(21): 2'-methoxy-nucleotide
aucauuuauugagcaccuguu

SEQ ID NO: 4027 - RNA, 21 nt, Artificial Sequence
  Description of Artificial Sequence: Synthetic oligonucleotide
  modified_base (20)..(21): 2'-methoxy-nucleotide
aaucauuuauugagcaccuuu

SEQ ID NO: 4028 - RNA, 21 nt, Artificial Sequence
  Description of Artificial Sequence: Synthetic oligonucleotide
  modified_base (20)..(21): 2'-methoxy-nucleotide
gaaucauuuauugagcaccuu

SEQ ID NO: 4029 - RNA, 21 nt, Artificial Sequence
  Description of Artificial Sequence: Synthetic oligonucleotide
  modified_base (20)..(21): 2'-methoxy-nucleotide
agaaucauuuauugagcacuu

SEQ ID NO: 4030 - RNA, 21 nt, Artificial Sequence
  Description of Artificial Sequence: Synthetic oligonucleotide
  modified_base (20)..(21): 2'-methoxy-nucleotide
aagaaucauuuauugagcauu

SEQ ID NO: 4031 - RNA, 21 nt, Artificial Sequence
  Description of Artificial Sequence: Synthetic oligonucleotide
  modified_base (20)..(21): 2'-methoxy-nucleotide
uaagaaucauuuauugagcuu

SEQ ID NO: 4032 - RNA, 21 nt, Artificial Sequence
  Description of Artificial Sequence: Synthetic oligonucleotide
  modified_base (20)..(21): 2'-methoxy-nucleotide
cuaagaaucauuuauugaguu

SEQ ID NO: 4033 - RNA, 21 nt, Artificial Sequence
  Description of Artificial Sequence: Synthetic oligonucleotide
  modified_base (20)..(21): 2'-methoxy-nucleotide
acuaagaaucauuuauugauu

SEQ ID NO: 4034 - RNA, 21 nt, Artificial Sequence
  Description of Artificial Sequence: Synthetic oligonucleotide
  modified_base (20)..(21): 2'-methoxy-nucleotide
cacuaagaaucauuuauuguu

SEQ ID NO: 4035 - RNA, 21 nt, Artificial Sequence
  Description of Artificial Sequence: Synthetic oligonucleotide
  modified_base (20)..(21): 2'-methoxy-nucleotide
ucacuaagaaucauuuauuuu

SEQ ID NO: 4036 - RNA, 21 nt, Artificial Sequence
  Description of Artificial Sequence: Synthetic oligonucleotide
  modified_base (20)..(21): 2'-methoxy-nucleotide
gucacuaagaaucauuuauuu

SEQ ID NO: 4037 - RNA, 21 nt, Artificial Sequence
  Description of Artificial Sequence: Synthetic oligonucleotide
  modified_base (20)..(21): 2'-methoxy-nucleotide
agucacuaagaaucauuuauu

SEQ ID NO: 4038 - RNA, 21 nt, Artificial Sequence
  Description of Artificial Sequence: Synthetic oligonucleotide
  modified_base (20)..(21): 2'-methoxy-nucleotide
aagucacuaagaaucauuuuu

SEQ ID NO: 4039 - RNA, 21 nt, Artificial Sequence
  Description of Artificial Sequence: Synthetic oligonucleotide
  modified_base (20)..(21): 2'-methoxy-nucleotide
aaagucacuaagaaucauuuu

SEQ ID NO: 4040 - RNA, 21 nt, Artificial Sequence
  Description of Artificial Sequence: Synthetic oligonucleotide
  modified_base (20)..(21): 2'-methoxy-nucleotide
uaaagucacuaagaaucauuu

SEQ ID NO: 4041 - RNA, 21 nt, Artificial Sequence
  Description of Artificial Sequence: Synthetic oligonucleotide
  modified_base (20)..(21): 2'-methoxy-nucleotide
guaaagucacuaagaaucauu

SEQ ID NO: 4042 - RNA, 21 nt, Artificial Sequence
  Description of Artificial Sequence: Synthetic oligonucleotide
  modified_base (20)..(21): 2'-methoxy-nucleotide
aguaaagucacuaagaaucuu

SEQ ID NO: 4043 - RNA, 21 nt, Artificial Sequence
  Description of Artificial Sequence: Synthetic oligonucleotide
  modified_base (20)..(21): 2'-methoxy-nucleotide
aaguaaagucacuaagaauuu

SEQ ID NO: 4044 - RNA, 21 nt, Artificial Sequence
  Description of Artificial Sequence: Synthetic oligonucleotide
  modified_base (20)..(21): 2'-methoxy-nucleotide
caaguaaagucacuaagaauu

SEQ ID NO: 4045 - RNA, 21 nt, Artificial Sequence
  Description of Artificial Sequence: Synthetic oligonucleotide
  modified_base (20)..(21): 2'-methoxy-nucleotide
acaaguaaagucacuaagauu

SEQ ID NO: 4046 - RNA, 21 nt, Artificial Sequence
  Description of Artificial Sequence: Synthetic oligonucleotide
  modified_base (20)..(21): 2'-methoxy-nucleotide
uacaaguaaagucacuaaguu

SEQ ID NO: 4047 - RNA, 21 nt, Artificial Sequence
  Description of Artificial Sequence: Synthetic oligonucleotide
  modified_base (20)..(21): 2'-methoxy-nucleotide
uuacaaguaaagucacuaauu

SEQ ID NO: 4048 - RNA, 21 nt, Artificial Sequence
  Description of Artificial Sequence: Synthetic oligonucleotide
  modified_base (20)..(21): 2'-methoxy-nucleotide
uuuacaaguaaagucacuauu

SEQ ID NO: 4049 - RNA, 21 nt, Artificial Sequence
  Description of Artificial Sequence: Synthetic oligonucleotide
  modified_base (20)..(21): 2'-methoxy-nucleotide
uuuuacaaguaaagucacuuu

SEQ ID NO: 4050 - RNA, 21 nt, Artificial Sequence
  Description of Artificial Sequence: Synthetic oligonucleotide
  modified_base (20)..(21): 2'-methoxy-nucleotide
uuuuuacaaguaaagucacuu

SEQ ID NO: 4051 - RNA, 21 nt, Artificial Sequence
  Description of Artificial Sequence: Synthetic oligonucleotide
  modified_base (20)..(21): 2'-methoxy-nucleotide
uuuuuuacaaguaaagucauu

SEQ ID NO: 4052 - RNA, 21 nt, Artificial Sequence
  Description of Artificial Sequence: Synthetic oligonucleotide
  modified_base (20)..(21): 2'-methoxy-nucleotide
uuuuuuuacaaguaaagucuu

SEQ ID NO: 4053 - RNA, 21 nt, Artificial Sequence
  Description of Artificial Sequence: Synthetic oligonucleotide
  modified_base (20)..(21): 2'-methoxy-nucleotide
uuuuuuuuacaaguaaaguuu

SEQ ID NO: 4054 - RNA, 21 nt, Artificial Sequence
  Description of Artificial Sequence: Synthetic oligonucleotide
  modified_base (20)..(21): 2'-methoxy-nucleotide
uuuuuuuuuacaaguaaaguu

SEQ ID NO: 4055 - RNA, 21 nt, Artificial Sequence
  Description of Artificial Sequence: Synthetic oligonucleotide
  modified_base (20)..(21): 2'-methoxy-nucleotide
uuuuuuuuuuacaaguaaauu

SEQ ID NO: 4056 - RNA, 21 nt, Artificial Sequence
  Description of Artificial Sequence: Synthetic oligonucleotide
  modified_base (20)..(21): 2'-methoxy-nucleotide
uuuuuuuuuuuacaaguaauu

SEQ ID NO: 4057 - RNA, 21 nt, Artificial Sequence
  Description of Artificial Sequence: Synthetic oligonucleotide
  modified_base (20)..(21): 2'-methoxy-nucleotide
uuuuuuuuuuuuacaaguauu

SEQ ID NO: 4058 - RNA, 21 nt, Artificial Sequence
  Description of Artificial Sequence: Synthetic oligonucleotide
  modified_base (20)..(21): 2'-methoxy-nucleotide
uuuuuuuuuuuuuacaaguuu

SEQ ID NO: 4059 - RNA, 21 nt, Artificial Sequence
  Description of Artificial Sequence: Synthetic oligonucleotide
  modified_base (20)..(21): 2'-methoxy-nucleotide
uuuuuuuuuuuuuuacaaguu

SEQ ID NO: 4060 - RNA, 21 nt, Artificial Sequence
  Description of Artificial Sequence: Synthetic oligonucleotide
  modified_base (20)..(21): 2'-methoxy-nucleotide
uuuuuuuuuuuuuuuacaauu

SEQ ID NO: 4061 - RNA, 21 nt, Artificial Sequence
  Description of Artificial Sequence: Synthetic oligonucleotide
  modified_base (20)..(21): 2'-methoxy-nucleotide
uuuuuuuuuuuuuuuuacauu

SEQ ID NO: 4062 - RNA, 21 nt, Artificial Sequence
  Description of Artificial Sequence: Synthetic oligonucleotide
  modified_base (20)..(21): 2'-methoxy-nucleotide
uuuuuuuuuuuuuuuuuacuu

SEQ ID NO: 4063 - RNA, 21 nt, Artificial Sequence
  Description of Artificial Sequence: Synthetic oligonucleotide
  modified_base (20)..(21): 2'-methoxy-nucleotide
uuuuuuuuuuuuuuuuuuauu

SEQ ID NO: 4064 - RNA, 21 nt, Artificial Sequence
  Description of Artificial Sequence: Synthetic oligonucleotide
  modified_base (20)..(21): 2'-methoxy-nucleotide
cuuagugacuuuacuuguauu

SEQ ID NO: 4065 - RNA, 21 nt, Artificial Sequence
  Description of Artificial Sequence: Synthetic oligonucleotide
  modified_base (20)..(21): 2'-methoxy-nucleotide
cagaccagcaugacagauuuu

SEQ ID NO: 4066 - RNA, 21 nt, Artificial Sequence
  Description of Artificial Sequence: Synthetic oligonucleotide
  modified_base (20)..(21): 2'-methoxy-nucleotide
ugaucuucuccaagaggaauu

SEQ ID NO: 4067 - RNA, 21 nt, Artificial Sequence
  Description of Artificial Sequence: Synthetic oligonucleotide
  modified_base (20)..(21): 2'-methoxy-nucleotide
guucauugcacuuugauuauu

SEQ ID NO: 4068 - RNA, 21 nt, Artificial Sequence
  Description of Artificial Sequence: Synthetic oligonucleotide
  modified_base (20)..(21): 2'-methoxy-nucleotide
cauugcacuuugauuagcauu

SEQ ID NO: 4069 - RNA, 21 nt, Artificial Sequence
  Description of Artificial Sequence: Synthetic oligonucleotide
  modified_base (20)..(21): 2'-methoxy-nucleotide
agcgauggaacuucgacuuuu

SEQ ID NO: 4070 - RNA, 21 nt, Artificial Sequence
  Description of Artificial Sequence: Synthetic oligonucleotide
  modified_base (20)..(21): 2'-methoxy-nucleotide
gcgauggaacuucgacuuuuu

SEQ ID NO: 4071 - RNA, 21 nt, Artificial Sequence
  Description of Artificial Sequence: Synthetic oligonucleotide
  modified_base (20)..(21): 2'-methoxy-nucleotide
gggaagggacacacaagaauu

SEQ ID NO: 4072 - RNA, 21 nt, Artificial Sequence
  Description of Artificial Sequence: Synthetic oligonucleotide
  modified_base (20)..(21): 2'-methoxy-nucleotide
ucuaccucaggcagcucaauu

SEQ ID NO: 4073 - RNA, 21 nt, Artificial Sequence
  Description of Artificial Sequence: Synthetic oligonucleotide
  modified_base (20)..(21): 2'-methoxy-nucleotide
ggugcucaauaaaugauucuu

SEQ ID NO: 4074 - RNA, 21 nt, Artificial Sequence
  Description of Artificial Sequence: Synthetic oligonucleotide
  modified_base (20)..(21): 2'-methoxy-nucleotide
caucaucaaaaacuuuggauu

SEQ ID NO: 4075 - RNA, 21 nt, Artificial Sequence
  Description of Artificial Sequence: Synthetic oligonucleotide
  modified_base (20)..(21): 2'-methoxy-nucleotide
aaggagucagacauuuuaauu

SEQ ID NO: 4076 - RNA, 21 nt, Artificial Sequence
  Description of Artificial Sequence: Synthetic oligonucleotide
  modified_base (20)..(21): 2'-methoxy-nucleotide
gugcugggcauuuuuauuuuu

SEQ ID NO: 4077 - RNA, 21 nt, Artificial Sequence
  Description of Artificial Sequence: Synthetic oligonucleotide
  modified_base (20)..(21): 2'-methoxy-nucleotide
gccggcuucaugccagcuauu

SEQ ID NO: 4078 - RNA, 21 nt, Artificial Sequence
  Description of Artificial Sequence: Synthetic oligonucleotide
  modified_base (20)..(21): 2'-methoxy-nucleotide
gggcaucaucaaaaacuuuuu

SEQ ID NO: 4079 - RNA, 21 nt, Artificial Sequence
  Description of Artificial Sequence: Synthetic oligonucleotide
  modified_base (20)..(21): 2'-methoxy-nucleotide
gaagggcacccuaguucuauu

SEQ ID NO: 4080 - RNA, 21 nt, Artificial Sequence
  Description of Artificial Sequence: Synthetic oligonucleotide
  modified_base (20)..(21): 2'-methoxy-nucleotide
caguucauugcacuuugauuu

SEQ ID NO: 4081 - RNA, 21 nt, Artificial Sequence
  Description of Artificial Sequence: Synthetic oligonucleotide
  modified_base (20)..(21): 2'-methoxy-nucleotide
acaaggagucagacauuuuuu

SEQ ID NO: 4082 - RNA, 21 nt, Artificial Sequence
  Description of Artificial Sequence: Synthetic oligonucleotide
  modified_base (20)..(21): 2'-methoxy-nucleotide
uggaggcacugaagugcuuuu

SEQ ID NO: 4083 - RNA, 21 nt, Artificial Sequence
  Description of Artificial Sequence: Synthetic oligonucleotide
  modified_base (20)..(21): 2'-methoxy-nucleotide
gcagggaccacacccuguauu

SEQ ID NO: 4084 - RNA, 21 nt, Artificial Sequence
  Description of Artificial Sequence: Synthetic oligonucleotide
  modified_base (20)..(21): 2'-methoxy-nucleotide
cuguacuguucugugucuuuu

SEQ ID NO: 4085 - RNA, 21 nt, Artificial Sequence
  Description of Artificial Sequence: Synthetic oligonucleotide
  modified_base (20)..(21): 2'-methoxy-nucleotide
uuaaacaccuccucauguauu

SEQ ID NO: 4086 - RNA, 21 nt, Artificial Sequence
  Description of Artificial Sequence: Synthetic oligonucleotide
  modified_base (20)..(21): 2'-methoxy-nucleotide
agacucucagggucgaaaauu

SEQ ID NO: 4087 - RNA, 21 nt, Artificial Sequence
  Description of Artificial Sequence: Synthetic oligonucleotide
  modified_base (20)..(21): 2'-methoxy-nucleotide
caugacagauuucuaccacuu

SEQ ID NO: 4088 - RNA, 21 nt, Artificial Sequence
  Description of Artificial Sequence: Synthetic oligonucleotide
  modified_base (20)..(21): 2'-methoxy-nucleotide
agauuucuaccacuccaaauu

SEQ ID NO: 4089 - RNA, 21 nt, Artificial Sequence
  Description of Artificial Sequence: Synthetic oligonucleotide
  modified_base (20)..(21): 2'-methoxy-nucleotide
ccaagaggaagcccuaaucuu

SEQ ID NO: 4090 - RNA, 21 nt, Artificial Sequence
  Description of Artificial Sequence: Synthetic oligonucleotide
  modified_base (20)..(21): 2'-methoxy-nucleotide
gacagcagaggaagaccauuu

SEQ ID NO: 4091 - RNA, 21 nt, Artificial Sequence
  Description of Artificial Sequence: Synthetic oligonucleotide
  modified_base (20)..(21): 2'-methoxy-nucleotide
cucccacaaugcugaauauuu

SEQ ID NO: 4092 - RNA, 21 nt, Artificial Sequence
  Description of Artificial Sequence: Synthetic oligonucleotide
  modified_base (20)..(21): 2'-methoxy-nucleotide
uacaaguaaagucacuaaguu

SEQ ID NO: 4093 - RNA, 21 nt, Artificial Sequence
  Description of Artificial Sequence: Synthetic oligonucleotide
  modified_base (20)..(21): 2'-methoxy-nucleotide
aaucugucaugcuggucuguu

SEQ ID NO: 4094 - RNA, 21 nt, Artificial Sequence
  Description of Artificial Sequence: Synthetic oligonucleotide
  modified_base (20)..(21): 2'-methoxy-nucleotide
uuccucuuggagaagaucauu

SEQ ID NO: 4095 - RNA, 21 nt, Artificial Sequence
  Description of Artificial Sequence: Synthetic oligonucleotide
  modified_base (20)..(21): 2'-methoxy-nucleotide
uaaucaaagugcaaugaacuu

SEQ ID NO: 4096 - RNA, 21 nt, Artificial Sequence
  Description of Artificial Sequence: Synthetic oligonucleotide
  modified_base (20)..(21): 2'-methoxy-nucleotide
ugcuaaucaaagugcaauguu

SEQ ID NO: 4097 - RNA, 21 nt, Artificial Sequence
  Description of Artificial Sequence: Synthetic oligonucleotide
  modified_base (20)..(21): 2'-methoxy-nucleotide
aagucgaaguuccaucgcuuu

SEQ ID NO: 4098 - RNA, 21 nt, Artificial Sequence
  Description of Artificial Sequence: Synthetic oligonucleotide
  modified_base (20)..(21): 2'-methoxy-nucleotide
aaagucgaaguuccaucgcuu

SEQ ID NO: 4099 - RNA, 21 nt, Artificial Sequence
  Description of Artificial Sequence: Synthetic oligonucleotide
  modified_base (20)..(21): 2'-methoxy-nucleotide
uucuugugugucccuucccuu

SEQ ID NO: 4100 - RNA, 21 nt, Artificial Sequence
  Description of Artificial Sequence: Synthetic oligonucleotide
  modified_base (20)..(21): 2'-methoxy-nucleotide
uugagcugccugagguagauu

SEQ ID NO: 4101 - RNA, 21 nt, Artificial Sequence
  Description of Artificial Sequence: Synthetic oligonucleotide
  modified_base (20)..(21): 2'-methoxy-nucleotide
gaaucauuuauugagcaccuu

SEQ ID NO: 4102 - RNA, 21 nt, Artificial Sequence
  Description of Artificial Sequence: Synthetic oligonucleotide
  modified_base (20)..(21): 2'-methoxy-nucleotide
uccaaaguuuuugaugauguu

SEQ ID NO: 4103 - RNA, 21 nt, Artificial Sequence
  Description of Artificial Sequence: Synthetic oligonucleotide
  modified_base (20)..(21): 2'-methoxy-nucleotide
uuaaaaugucugacuccuuuu

SEQ ID NO: 4104 - RNA, 21 nt, Artificial Sequence
  Description of Artificial Sequence: Synthetic oligonucleotide
  modified_base (20)..(21): 2'-methoxy-nucleotide
aaauaaaaaugcccagcacuu

SEQ ID NO: 4105 - RNA, 21 nt, Artificial Sequence
  Description of Artificial Sequence: Synthetic oligonucleotide
  modified_base (20)..(21): 2'-methoxy-nucleotide
uagcuggcaugaagccggcuu

SEQ ID NO: 4106 - RNA, 21 nt, Artificial Sequence
  Description of Artificial Sequence: Synthetic oligonucleotide
  modified_base (20)..(21): 2'-methoxy-nucleotide
aaaguuuuugaugaugcccuu

SEQ ID NO: 4107 - RNA, 21 nt, Artificial Sequence
  Description of Artificial Sequence: Synthetic oligonucleotide
  modified_base (20)..(21): 2'-methoxy-nucleotide
uagaacuagggugcccuucuu

SEQ ID NO: 4108 - RNA, 21 nt, Artificial Sequence
  Description of Artificial Sequence: Synthetic oligonucleotide
  modified_base (20)..(21): 2'-methoxy-nucleotide
aucaaagugcaaugaacuguu

SEQ ID NO: 4109 - RNA, 21 nt, Artificial Sequence
  Description of Artificial Sequence: Synthetic oligonucleotide
  modified_base (20)..(21): 2'-methoxy-nucleotide
aaaaugucugacuccuuguuu

SEQ ID NO: 4110 - RNA, 21 nt, Artificial Sequence
  Description of Artificial Sequence: Synthetic oligonucleotide
  modified_base (20)..(21): 2'-methoxy-nucleotide
aagcacuucagugccuccauu

SEQ ID NO: 4111 - RNA, 21 nt, Artificial Sequence
  Description of Artificial Sequence: Synthetic oligonucleotide
  modified_base (20)..(21): 2'-methoxy-nucleotide
uacaggguguggucccugcuu

SEQ ID NO: 4112 - RNA, 21 nt, Artificial Sequence
  Description of Artificial Sequence: Synthetic oligonucleotide
  modified_base (20)..(21): 2'-methoxy-nucleotide
aagacacagaacaguacaguu

SEQ ID NO: 4113 - RNA, 21 nt, Artificial Sequence
  Description of Artificial Sequence: Synthetic oligonucleotide
  modified_base (20)..(21): 2'-methoxy-nucleotide
uacaugaggagguguuuaauu

SEQ ID NO: 4114 - RNA, 21 nt, Artificial Sequence
  Description of Artificial Sequence: Synthetic oligonucleotide
  modified_base (20)..(21): 2'-methoxy-nucleotide
uuuucgacccugagagucuuu

SEQ ID NO: 4115 - RNA, 21 nt, Artificial Sequence
  Description of Artificial Sequence: Synthetic oligonucleotide
  modified_base (20)..(21): 2'-methoxy-nucleotide
gugguagaaaucugucauguu

SEQ ID NO: 4116 - RNA, 21 nt, Artificial Sequence
  Description of Artificial Sequence: Synthetic oligonucleotide
  modified_base (20)..(21): 2'-methoxy-nucleotide
uuuggagugguagaaaucuuu

SEQ ID NO: 4117 - RNA, 21 nt, Artificial Sequence
  Description of Artificial Sequence: Synthetic oligonucleotide
  modified_base (20)..(21): 2'-methoxy-nucleotide
gauuagggcuuccucuugguu

SEQ ID NO: 4118 - RNA, 21 nt, Artificial Sequence
  Description of Artificial Sequence: Synthetic oligonucleotide
  modified_base (20)..(21): 2'-methoxy-nucleotide
auggucuuccucugcugucuu

SEQ ID NO: 4119 - RNA, 21 nt, Artificial Sequence
  Description of Artificial Sequence: Synthetic oligonucleotide
  modified_base (20)..(21): 2'-methoxy-nucleotide
auauucagcauugugggaguu

SEQ ID NO: 4120 - DNA, 21 bp, Artificial Sequence
  Description of Artificial Sequence: Synthetic oligonucleotide
  Description of Combined DNA/RNA Molecule: Synthetic oligonucleotide
  modified_base (20)..(21): 2'-methoxy-nucleotide
tcctaagagtgctgggcatuu

SEQ ID NO: 4121 - RNA, 21 nt, Artificial Sequence
  Description of Artificial Sequence: Synthetic oligonucleotide
  modified_base (20)..(21): 2'-methoxy-nucleotide
augcccagcacucuuaggauu

What is claimed is:

1. A nucleic acid molecule, wherein:
   the molecule has a polynucleotide sense strand and a polynucleotide antisense strand;
   and wherein the antisense strand is UUAAAAUGU-CUGACUCCUUmUmU (SEQ ID NO:4103) and the sense strand is AAGGAGUCAGACAUUUUAA-mUmU (SEQ ID NO:4075), or chemically modified strands thereof, wherein mU represents 2'-methoxy-U.

2. The nucleic acid molecule of claim 1, wherein the polynucleotide sense strand and the polynucleotide antisense strand are connected as a single strand, and form a duplex region connected at one end by a loop.

3. The nucleic acid molecule of claim 1, wherein the molecule is an RNAi molecule active for gene silencing.

4. The nucleic acid molecule of claim 1, wherein the molecule is a molecule active for gene silencing selected from a siRNA, a shRNA, a dsRNA, a DNA-directed RNA (ddRNA), a Piwi-interacting RNA (piRNA), and a repeat associated siRNA (rasiRNA).

5. The nucleic acid molecule of claim 1, wherein the molecule is active for inhibiting expression of p21.

6. The nucleic acid molecule of claim 1, wherein the molecule has an IC50 for knockdown of p21 of less than 100 pM.

7. A composition comprising one or more nucleic acid molecules of claim 1 and a pharmaceutically acceptable carrier.

8. The composition of claim 7, wherein the carrier is a lipid molecule or liposome.

9. A method for inhibiting p21 expression in a cell, comprising contacting the cell with a composition of claim 7.

* * * * *